United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 20

SEQ ID NO: 836 - DNA, 201 bp, Homo sapiens
gatttggatccattgccagggagttggtcttttggggttgttatagaatcctgtttgtcatattaccagaattattttctgggggttccttttcatttggwtgactatttctgtggagagttctgaaactcaaggcctgctgttcagattttcttgtcccatggggtgaccccttgatgtagtgccctcccccttacccta

SEQ ID NO: 837 - DNA, 201 bp, Homo sapiens
ttttaatgtattttcaatatctgtgttaaatttctcattttggttttttactatgttcctgattttttaaaaatgatttctctgtattttcctttacttcrtgaagctttaaaagcaattatgttgaattatttttcagcctgtttacatacctccatttctttggggtcagcaacttggaaattattgtgttcttttggt

SEQ ID NO: 838 - DNA, 201 bp, Homo sapiens
ctcagcatttccaagcctgagggtgcaggggagcagatcctctccgttttggaactccagtgaggcagcagctctggctgatagtgtggccatttgtaatkcttcttgattggctaactgggaaacctgtgtgagcctagggccattctcagggtgttatttacctctccggggttagacagaacaggcaactggtgagaa

SEQ ID NO: 839 - DNA, 201 bp, Homo sapiens
gcaactggtgagaacagcaaagccacagaaacactggggtgagttttgtttgtgaccatgggtttcttttgtactaatgattgattccaccttgaaagtaragagaatggttccaggaagtgtatagcacattacaaagggctttcgcctccatctggtctttgagacaaacacaagtgctaggctctgggattcagagat

SEQ ID NO: 840 - DNA, 201 bp, Homo sapiens
ctgaataatgtatttttcagcaatattcttttgataaatttgaaggacttggctaagatgttctcacatctgtcctcctatgggagaaaaaaaagtattarcctatctgagcctgaatggagattagcctacatagaaatctaaaatttgctgggaagcaatcctgaaccaagatctccaagttttagactagtgaacact

SEQ ID NO: 841 - DNA, 201 bp, Homo sapiens
cccaacctcaaatctgtgaagctaaccaggttccctaataggcataagaaagaaactgagaagaggaaaggaaaatcacaaagcctcaaccactgttcttrgaggaaggtatggagaaggggaaatttatgaggcagtaacaagtcagaaggcatttcaataattagttagttaaattggggtaaaatacacaacaggatt

SEQ ID NO: 842 - DNA, 201 bp, Homo sapiens
caaattcccagctgcttataaataaatgacccccttttgggattttacctagtacaattctaagagactctcagcttagctgagtttctgtaatcaatagmaacttcctagcctgtgctttgcctcaatgtaaaaagcaatttgaatctctccaggaatttaaaaacatgaactattgaaattcaggatcatacgcttgga

SEQ ID NO: 843 - DNA, 201 bp, Homo sapiens
atttaagaataactagaaagcaagtaagtagctttacatggttggcagcttccttgccaatctccactactcttcttagcctctggtaaccatcattctaygctctactttcattgaatctcaatcagttcaattgttttaatttttagctcccacatataagtgaaaatatacgaagtttgtctttctgtgcctggccta

SEQ ID NO: 844 - DNA, 201 bp, Homo sapiens
atgaaacctccccatgtaagattcctgccttctgcataaacatcctgtgtgtgaaagattggtatatggcagaaggatcagctgggtacacagaggagcayggtggggagctaaagggagggcacaacaacgaggggatggcattatggctgttttatagatcaggaaactgaggctcagagaggtttcatcacttgtccc

SEQ ID NO: 845 - DNA, 201 bp, Homo sapiens
tgaagtcaaaataaagatattgtgttggtgcccctcccctgatcccatgaattccctgtgcccttacttacgccaacaattattctgacttatcctcctaytcaaggccagtcttttcactgatccccatgactgcctcccatcacattacctccaagaccgcttcagtcctcaattattgcttttttgtcataacttcag

SEQ ID NO: 846 - DNA, 201 bp, Homo sapiens
tagcagggaggaaacgttaactgttaaaacaggagttagagacaggtaaggaagaggagttggacaataagaagtaggtggtcggttaggaaaacagggarggctaaggaagcaattatgataaatatggagtctgatatcttattgcctgaatacagtgatttggtgagttttagttttttgatagtttttgggatgtct

SEQ ID NO: 847 - DNA, 201 bp, Homo sapiens
accccttgatgtagtgccctcccccttaccctagggatggggcttcctgagagttggacagcagtgattgttattgttcttctggatttagccatccatcrgggctaccaggctctgggctggtgctgggggttgtctgcaaagggttctgtgatgtgatccatcttcaggtctcccagctgtggataccagcatctgctc

SEQ ID NO: 848 - DNA, 201 bp, Homo sapiens
ttggtggaatttggagggcttctttatcgccacccattttgttaataaggtctttatgacctgtatcttgtgctgatctgctatgtcatcctgtgccttasagtgcctaacctcctgggagtgcaacccagtaggtctcagcctcattttactcagcccctattgaagatggagtcactctggttcaaatgcttctgacag

SEQ ID NO: 849 - DNA, 201 bp, Homo sapiens
ttacaaatttgacagcttatgattactctgtataggaaactaggaaggagagaggcctctgcatctgacttctctgtgataggatatctttggagagaagwatgttcgaaaagaccagtctgaccaatcttatttttcaaaacctcatagtacatgaggttctatgacaggaaaagtgaaataagaaaccacaaagtaggg

SEQ ID NO: 850 - DNA, 201 bp, Homo sapiens
tcagttctgtcttgaaattttcaaacttatcatttaagtatttttttttccaagaaagtaagtatattttctgaactcttgtctgagtggtattcttttgyttttattcaagaatctcatgctcaatgaaatttttcatatgtaaagccaaagtaagttaatctgatttccttctttgtgtattctactgggatcattctt

SEQ ID NO: 851 - DNA, 201 bp, Homo sapiens
ccccaatgtatgttcttggcaccattgtaaaaaatcaattcactctagatgtatgggtttatttcctggttctctattctgatccactggtctgtgcattkgtttttatgccagcagcatgccattttggttactatagctctgtagtataatttgaagtgaggtaatgcaattcctccagttttgttctttttcccaaga

SEQ ID NO: 852 - DNA, 201 bp, Homo sapiens
gagttttccgggaggacttcttagttataaatacaaacaagatgtaattgttattataaatttacttattctgctgtggttggagagagagcagagaaagratgtggtggtaggtatggtattgggaagggactatgaacttctccttcttggaaggtgaaagtgtccacagtgaaggcagaaaaggaaggtaggctagag

SEQ ID NO: 853 - DNA, 201 bp, Homo sapiens
cactgcactctagcctgggccacagagtgagactttgtctcaaaaataaataaataaataaataaataaataaaaaataaaggaacatgagagagaagtgrtgggaaaaattgataggttaagaagttaaagtttacagtggtagttctagaaagaaggcaagagagagaatgagatttttgaaggtttattttatgtaac

SEQ ID NO: 854 - DNA, 201 bp, Homo sapiens
atcataactattgactcctcacattgacttatggaaaacttcattaaataattctgaataaatacattttattgatggatcctatgaaaaaactgtagagragaaatactgagcaagacatgctgtaacaactcagtatgaactaatagaaaagggaattctttctcagtttaagtcaggacaacccgaagaattacgtga

SEQ ID NO: 855 - DNA, 201 bp, Homo sapiens
tcctcacattgacttatggaaaacttcattaaataattctgaataaatacattttattgatggatcctatgaaaaaactgtagagaagaaatactgagcargacatgctgtaacaactcagtatgaactaatagaaaagggaattctttctcagtttaagtcaggacaacccgaagaattacgtgatctaagacttaacca

SEQ ID NO: 856 - DNA, 201 bp, Homo sapiens
ttaaatttagctgagagtatatatgttatgtgactattgtaaaagataatttatattcataaaattctgaacccattcatttataattcttggtaaaattkgctgcttttgttttcatattctgttagtgtatgtaacctaacacattcataagggtaacagaaaccttttttacggtttagtacttgatttgaggttatt

SEQ ID NO: 857 - DNA, 201 bp, Homo sapiens
cagctgctaacaacaaacgtcagcttagtgaaaaccgaaagcccttcaactttttgcctatgcagattaatactaacaagagcaaagatgcatctacaaaycccccaaacagagaaacgattggatcagcacagtgtaaagagttgtttgcttctgctttaagtaatgacctcttgcaaaactgtcaggtgtctgaagaag

SEQ ID NO: 858 - DNA, 201 bp, Homo sapiens
tagtaatgcacagtgtgtttctaataatagagatgggcgaacagttaattctaattgtgaaattaacaacagatctgctgccaacataagggctctaaacrtgcctccttctttaggtatgactgactgtatttacatataattttgctgtgttattcttacaaagtgggttttcgttcatgtgtgctctttcctttaaaa

SEQ ID NO: 859 - DNA, 201 bp, Homo sapiens
ttcacccgctatcagagttttacttgtttccttatctagattggggagagtcttggatagaccggcctgccatccaacgtccttggtttttagccctggarattatttagttcttctggtaaggagagggcattttctcttacctggttaatctgaattcacgtgtgttttgctagttctcccctgactttgggatctttc

SEQ ID NO: 860 - DNA, 201 bp, Homo sapiens
tcaaagattaaaaagtacaaacggctggatttctgttacagacatgcttacaatccatctgtggataaggagcatacagaatacattaaagagataaacawtatagcaccaagtgttttgttttttttttgagacagagtctcgctcaggctggaatgcaatggtgtgacctgggctcactgcaacctccacctcctaggt

SEQ ID NO: 861 - DNA, 201 bp, Homo sapiens
tttatgcatatcacactattttccaaaagaattgaggtaacttaaatttaaaatatgaataagttatatttttccccttcttttgatctttctaaacataytttagaccaaaactgaagtattttttattctgtatttcatagcgtaagtaatttacttaagtgatacatatttttaatcctaattaggaaacagctttga

SEQ ID NO: 862 - DNA, 201 bp, Homo sapiens
aaggtaactgtttggtttcttatcacattctacttgatacacttttccccttttggcaggctctcctggtttccctcctgtctttctgtaccttattagtrtattagcgtgtccttttcctctgcctctctatttaataccagtgtatttaagatctggtcttctcttactctttatcgtctccctgagtcctctgtccca

SEQ ID NO: 863 - DNA, 201 bp, Homo sapiens
tttttgttaatgaattaggttatgtgagtttaactaagtaaataaaaatgttttctatttgaaactataagcactttttgtaattccatattagctgttaycatgtacatttttacctataaaaataatagctgtctttattgcttactaaatgctaggtactaattagttttaatcctattttgaaggtgacactatttt

SEQ ID NO: 864 - DNA, 201 bp, Homo sapiens
aaaatgtagaaaggtagattcaagtctgataatgatgttggtaatgatcatgtatcatttatttatatctatttatcaattattgaacacttaactgtatrtcaggcactgagctgaatactttttcagacagttcttcatgtagacacaactttaattacattgattcattgggtccaaagcgtataaaaatactataag

SEQ ID NO: 865 - DNA, 201 bp, Homo sapiens
aaggtgcacatgaaacataaatgaattttatgtttagactccggtctctttcctaagatatatctcatgtttatgcatatattccaaaatttgaaaaaaartgaaactcctaacacttcttgtctgaaatattttggataaggggtactcaagctgtacttcatttagacttaccttgttcatattcgtcagttgaattgt

SEQ ID NO: 866 - DNA, 201 bp, Homo sapiens
gaaaaatcgagagaaagactagtaaatgggacaggatagcatttacattgtgacttattcacaatgagaaaaatgctgtaattgctgacttggcaaaatgraatttgttgaagtactgtttttctgaagaatagtaatttacagaactttgaggaaagatttctaaaacttagtgtggttcaatgctagggtgtttttagg

SEQ ID NO: 867 - DNA, 201 bp, Homo sapiens
gtaaaggaattctgttggggaggagtgggaacttgtatagatttattgtaatttatataaagtattcattgtgatggcaatttctttcataatataaaatsacggtatgaaagttgactaataacatgtagcagagtaaatgttaaaaatgtgctttaacaactgtgtggtatggtaattccgcaggatgtggtacttgct

SEQ ID NO: 868 - DNA, 201 bp, Homo sapiens
acctgctccactgagtcactactattaattggaatgtaatagtaaccctccttgtatgttgggacaggaaaagatgaaccactttaccagagttttgtgascatccctttatttttaagttaggtggtaacttctaataaaatgattgttggcagatagatcggattgttaactagtttcaagttacgtatgtgagctttt

SEQ ID NO: 869 - DNA, 201 bp, Homo sapiens
ctcagattgcaggcacaaaaagtacatattactaataaactctgtctttacctccattaataatcctattcttcttcactgaagttgctaggccttttctstgcagttaggtacatcactatgcacctatttttaaaaaaatacatgacgttttgtggtatgtttctttgtttttacaaactgtatatataatacactaag

SEQ ID NO: 870 - DNA, 201 bp, Homo sapiens
ggccaacaaaaccagctaaattagactgccattctgataaatgtataaaggcttgttgaacctgtgctttgtttaaaggaactacaattttatctggatcwgtgccagtgaatctaactattcttaattgggcttggcctataagaatagctatttgatctaagtaaattgaaaaagtcctagttgtactgtggggtaaaa

SEQ ID NO: 871 - DNA, 201 bp, Homo sapiens
tttcaaaacaattgcttttagtacttttaaatatggcatcacttctgttgcctggctgttttattcttcagtattacaaattatgtcagtatatgtagaayacagtagttgcaaaatgttttatttaaatgagtcattttggttcactggatatacttctatgggtattattttttaaagttttaaaatatatttctagta

SEQ ID NO: 872 - DNA, 201 bp, Homo sapiens
aaacttgcataatctcctttgatcatcagagatttctaggttagtcagagctttaattcttatttctgttttatagagaaggaactctacagagtttgtgrcttgcctagatttatatagaattttagcagaattacatttcttgaattgtaggtcaggggtcttgtttctttttctgaatatgaacttttgaaagtaagc

SEQ ID NO: 873 - DNA, 201 bp, Homo sapiens
atgcacatgagtttgaacttcatactatttcaaaaagaattttagcttagtaattttaaaacaaatttagtcttgtatttatgagattttgcaggggcatrctaatgaaaagccatggaaagctacaattacagtatttaatctagtatatgagacattatcttgggataattatgttacctcaaagagtgtccctttcac

SEQ ID NO: 874 - DNA, 201 bp, Homo sapiens
atccatcctaagaagacaaaaggggaaaaaaaaaaaagacattaagatttagtgttgtctcaacagtatggtttcaactatgtataaacaaaaatttgaawgcaaaaaggccggaagaaaatgcatcaaaatgttaatagtggttttatcatctttaaactcataatgagcatttatcattttgtaatcagaaaagaaaca

SEQ ID NO: 875 - DNA, 201 bp, Homo sapiens
caatggctgctgtatactaggcactgtgtaaaacgctgggagagtaaagatgaataagacagtgctctcctaaaggagtaccatgtcttgttagggggatrctaatagactaaaggagagcacatttagcttaagcttttctttggatggttttttctgcactcattatgtaccagacactatgtaagttactgggatcta

SEQ ID NO: 876 - DNA, 201 bp, Homo sapiens
cagggtctagtgaggatgctgttaatgaatgcttatagtacagtgccacgggtgccataacagtagtgcaaatgctgggaagtgtcagcaaatcagttccsccgccaaaaaaaaaaaaaagagttgatatttaagctaaagaatgaatagaatttatttccagagagattagaaatgaaagggctttctaatagaaccact

SEQ ID NO: 877 - DNA, 201 bp, Homo sapiens
ccgaagtaatatggggtaaaatcaaattagctcaatccttgctattcaaactctgaactgtggacaagcagcattacatcatctgggatattattagaaaygcgtgcttttgggcctcaccttatgccaactaaatcagtatgtatttttcttcagtatgcattttggcaagatttttggtatgaagatatgtacgtgaaa

SEQ ID NO: 878 - DNA, 201 bp, Homo sapiens
aagagtgctaaggagaatggtataaattcagtaagctgtgtcctccaaatagcacttagcacatcgttgattgaataacagtgacagaactgctagtataytgaggagataatgtgctaggtgtttgggaatcacctatttcaaggttcaggccttgattttattgtaaaatatttcatgtggtcgtgggatagcaaatac

SEQ ID NO: 879 - DNA, 201 bp, Homo sapiens
agctactgacccattgcttattatacgttacagttaaatcgagttgtcagagcatatccaaaccatctaaaagcagtgacagcagcagctaaattgatagraactttatctgacctagtattagggaataaatgttacctacaagttacacgtgcagttgaaagctcattaccttccagtcagatccaacatgtcttaata

SEQ ID NO: 880 - DNA, 201 bp, Homo sapiens
tccaaaccatctaaaagcagtgacagcagcagctaaattgataggaactttatctgacctagtattagggaataaatgttacctacaagttacacgtgcarttgaaagctcattaccttccagtcagatccaacatgtcttaataagtagactaacattttatgatatccttctcctgtcaccttctaatctctatctcag

SEQ ID NO: 881 - DNA, 201 bp, Homo sapiens
tgtcgttttacatgagctgtactttctccagtttagcacgtagcccagataaaccaagagaaattatcaacagtaacatgcacaagagaaagttttcccartgatgggacatgagtcacattcatttgccaaagagcatttggtttaagccccctaggattaactccaggttcttgagtaggtagctgtagcacctggcat

SEQ ID NO: 882 - DNA, 201 bp, Homo sapiens
agtgactgccccagctgccacttggagaaagccacggggtgagcaggacagcacctgtgaacatttcctgtgctctgggtctggtgcttctcaagtttaayacccaggggcgagtggtcagggactgatccttgaggaactgatgtacattaaacaaactatcaagtccctgcaatgcagtgtaaatgagtaaagagcctg

SEQ ID NO: 883 - DNA, 201 bp, Homo sapiens
gctaagacttgagccaacctgccttgactcaaatcctgcttctctagttactgtgtgaccttgagccaattactttgcctctctgtgccataatttccacrtcagttaaatggagatgataatagtacctgcctcttagggttgttgtgaggattacatttgccaacatacacagagcatggtgtgtaataagtccttgga

SEQ ID NO: 884 - DNA, 201 bp, Homo sapiens
cactcgcaccatcctcttccttgtcactgcctcccctgacctcttcctgtcttctcctctgcccaggctgatgggaaccaccctgtagaggtccatctgcrttcagacccagacgatgccagagctatgactgggcctgcaggtgtggcgccgaggggagatcagccatggagcagccacaggaggaagcccctgaggtcc

SEQ ID NO: 885 - DNA, 201 bp, Homo sapiens
catttggcctggagggaggcacttgggaagaactgtctggttgttccttgatgttattgccagacttgcagagggtagagaggtgcatgaagtcttactcygcctctccccatctgtgtctctccctgtccctgtccagcgccccatctgctctgcctactcaccactcctgccttttttttttttccttccatacaaatc

SEQ ID NO: 886 - DNA, 201 bp, Homo sapiens
caatctttggccaactgaatgtgcctctgatgttggtcactgaacatgttctcttggagtctcttctccctcttttttctttgttcttttctgaatctagrgaatccaaattgtccctctttttccctgggagcttaatttcctctgtatccaggaggaacggcaatcccagagctctgttccctttgcccaggcatagta

SEQ ID NO: 887 - DNA, 201 bp, Homo sapiens
catctgcttccagtcacatagatcatcttctctggggcttgagagcccaccaccttccatgtgtgtctggatgtttaaccttaccaagcagaagattctcrtcatatccttcagtttgagctcctttatttggcgttggttctctaaagaagtattcaagaaataacatatcctttgtttctacccagtctgatcttggag

SEQ ID NO: 888 - DNA, 201 bp, Homo sapiens
ccgttcctgagggcagagccttcatgacctaaacacctccaaaggccacacctcttaataccgttgtattggggattaagtttcaacatgaattttggagkgttcacaacattcaaaccatagcaatgtcttatagagtaatcgggatgattaaatgaaagaatgcccataaaacattgaacacatgcctgactctttgta

SEQ ID NO: 889 - DNA, 201 bp, Homo sapiens
gccctgatggtaatagctgctgtgtactggacatcttctgtatgttaggctctgggagaaatgctgtggagactttttgcccatcctcccagagaagctgycagtaccccctgttctaggtgaagaaactggtcctcagaaaggttgactccctgaggccacacagctgttaagtggctgaggcgagggctgtggggctgt

SEQ ID NO: 890 - DNA, 201 bp, Homo sapiens
cagacgtaggctctggatcactcagggttagccccaagccaggtgaaccatctactctcaatatacccaaaaaggaggctctgatgggctgccttcctccyatccgatgtggagtgtcctcaccacatacagtttcgggcagccccctcctggctacctttcatagtggcctttgctaggacatcaacactattctaattt

SEQ ID NO: 891 - DNA, 201 bp, Homo sapiens
aggaagttgtaaaattcaattttaaaatctctcctttaattttaagttaattcctcttactttttttttttaactttcgcatcttgtctcccacacagggmagtacagtctggcagagagagactgggctttggaggcgtaagatgggaattcagggagtcttagaaacagagctggaagcgctcttagaggccatgatcc

SEQ ID NO: 892 - DNA, 201 bp, Homo sapiens
gttcagattcaaggagaggactacacaagggtgtgaatactaagaggcgtgattcactgaggagagaaacaggcctccttggagaccagctactacttttyagcatccttatgtgaggtaatgtggtcttgatacttccaagagaaaagcacatcttctcatgattttcattcctggaagctactgttagttaggaaattc

SEQ ID NO: 893 - DNA, 201 bp, Homo sapiens
ggcattttattgtctttcatggttctgtggattaactgggcccagctgggtggttcttgcttgggatatgtcatgttgctatagtcaaatgaagacggggyaggtgtcatctgaaggctcagctgggctgggtgtccacgctggcttaggcacatgggtggcacttgatgctgttgaatggagtgcgtatacatgacctct

SEQ ID NO: 894 - DNA, 201 bp, Homo sapiens
tttttctttctgtctgtctctctttcctttctttctttccttccttcctttcctttccttctttcctttcttttctttcctttttttgagacagcgtttcrttagttctgtcactcaggctggagtgcagtggtgcaatcttggctcactgcaacctctgtctcctgggttcaaacaaatctcctgcctcaacctcccaag

SEQ ID NO: 895 - DNA, 201 bp, Homo sapiens
tcattttttctgctaccgtgactaagatggaagcgtttttggggtcgcggtccggactttgggcggggggtccggccccaggacagttttaccgcattccrtccactcccgattccttcatggatccggcgtctgcactttacagaggtccaatcacgcggacccagtaagttctcggcgctttcgtttgcgtagcgggag

SEQ ID NO: 896 - DNA, 201 bp, Homo sapiens
gactcctattttcacattggggaagacctccacctgacctttcatttaaggacttaaggcgtgggcattattgaatgctctgctttcttccagtttcaaaycgccactgtcaccgaaaaaggtgttgaaatagagggaccattgtctacagagaccaactgggatattgcccacatgatcaggtgagtaatagggaaaaaa

SEQ ID NO: 897 - DNA, 201 bp, Homo sapiens
accaagtgcaaaactgctgagtactgccatgtgccatctccctccctggtcggagaacccttgtggtcttgcagcacacacagaaattctctctgcacaayacagaaagacacactagcgtcatttggagctgtattagaagcagagcttcctgtagaagccagacttaatttttgtgtgctaactggcttttgtgttcaa

SEQ ID NO: 898 - DNA, 201 bp, Homo sapiens
aataagccctccaaagacagtgccctgggattcaacttactacatacaaatacgctgttcgcagtgaccagctttcccagttttatataaacttcaggtcrgaaggtttctaattaggtccagcacatctcaacagtgaatgagtgaggccaagtaggtatgctcctgatgcatacagtacgaacctgtatcttttttcct

SEQ ID NO: 899 - DNA, 201 bp, Homo sapiens
ttttctttagtaggataacaaagctctgtaagcttaggctaagagacaatttccatgcccctatttggaaatacagttgtggtagacaatcagcagtcacyactgtgcaaaggagactatgagtgtaatagggtacatatgtttgtgtgcatatgtatgtgactattaagcacacatgcactcatcttattctccattttg

SEQ ID NO: 900 - DNA, 201 bp, Homo sapiens
aatcttcctacatgcaagacagtgctatagattcttcttccaaggatcaccactggtcacgtggtaccctgaggcacatctcggagaactcctttgggccrtctgggggcctgcgggaaggaagcctgagttctcaagattccaggactgagagtgccagcttgtctcaaagccaggtcaatggtttctttgccagccatt

SEQ ID NO: 901 - DNA, 201 bp, Homo sapiens
tcctggtttgtatactgatacttaaaagccttccatttataattttccatttaatgaaaattccatatgaatattatttcaaatatactatagatctctayatatgctttggactaatgctctccaacagaactttctgtgatgaaggaaatgttccacatgtgcactgttcaatatagtagccatatgtaactactgagt

SEQ ID NO: 902 - DNA, 201 bp, Homo sapiens
atggtataggaactcaatggagtattatacacatcccaggactccaggcaatgtgttaattacaacaagcagaattacaaattaaatgtactttatggttrtataattaagtatggaaagggaccacgtcaggaggaacatggaaatatgaaattagttaatttgttaagatggtggaatagtgagtgatttctcttctat

SEQ ID NO: 903 - DNA, 201 bp, Homo sapiens; identical to SEQ ID NO: 153

SEQ ID NO: 904 - DNA, 201 bp, Homo sapiens
acagagagaattgccctcattttactcctgaggaagcagaggcatagagacatttactccttagagtttgtcagctgaaaaaggtagactttaattgaagkcgatagaagcaggacagttaggaaacggaaaagcccggctgccaggggttacggacacaggcaattccctatgaaagtgctttcttcacttgccttcact

SEQ ID NO: 905 - DNA, 201 bp, Homo sapiens
tagccagattatccaagtaatctttagcttaaagaagggtgtgttcctctccttactcctttcataagtagcctgtagcaagaggctttctcatcttaccyagatcagggatcttgtttggcccaataaaaactgaaggttaaaaaatctgacttctactgttttacaaagcagaaaatataaatttccacccagatcagt

SEQ ID NO: 906 - DNA, 201 bp, Homo sapiens
atcacaggagatgacagctaaatgcttgttattgcccctgaagaccttctagtgagacaagatgtggagaagatagtgatattgatgatcctggttctgtrtaggcctaggctaatgtgtgtgtttgtgtcttagttttttaacaagaaaaaaaaattaaaatttcagaaatagaaaaaagtatatagaatataaaaaaat

SEQ ID NO: 907 - DNA, 201 bp, Homo sapiens
cattgctccctctcctgtacttgtttcactctggtgcacataacacttcagcaccagtatttctagacattttctggacttcttcatgttaagtgctcacrgatgtctgttactgaatttgaaagctggattgtttttctttctataagtgtgtagaaatgccagcttcagttggataggagttctaaaacattacatcac

SEQ ID NO: 908 - DNA, 201 bp, Homo sapiens
acattttctcttattatcaccttgttctctgcctgccttggatggtttcagcttgtctcttaacatcaagatgttgctattaacagtcttctctttcttarcagcttacagtcacttccttttattcagtccttttccttttccctcccaaaccacgtaatcatctctttcagcctcaaataaaagttgtataaccatttc

SEQ ID NO: 909 - DNA, 201 bp, Homo sapiens
agactttttattaatggagaaaatataaagaaagccaactagattcttagatcctatggccagaggtgaaatcctgacagcgagagttgctttgtaaattracttatgagggatatagtggattaaaatgtctttattgcaccaattatgaaaaattataggcaaaatacagttaaaacaagcaaaatatttcagcaagaa

SEQ ID NO: 910 - DNA, 201 bp, Homo sapiens
tataaagcagagtaaagatttagaacaggagttttgaattcaactactttgtggctatatgaccctaggcaacttgtttaataactcagagaccctgtttkctcatgcaaaatggggacgataatacctgaatcactggagtgttgtaatgattaaaaataaatgtatgtgaagcattctgccaggaaatgtaaactaaag

SEQ ID NO: 911 - DNA, 201 bp, Homo sapiens
ccctgagtgatggctctgtgctgggtatatagaaaagatcaggctcagcttaccaggcagaagcctaaatcccttaccagtggccagccagccctccaagyagtacaagactgtaaggcactggagggagcagcagcaggtggctaatctttgagcccctgtgtaattctgttggcacaggttaaagaacttgacagctgc

SEQ ID NO: 912 - DNA, 201 bp, Homo sapiens
ctttctgaaatagcttcgggcaacacagtttcttccgttctcagacgtatgtgatagtaggaaatgcgtaagttactgcagcatttaaaaattctggtccrtttaattttcattagttcttatttgtgtttcaagaaatctagtgttccatattggttgatttcaatattcagtcagaacaacaggtattgattcatgaag

SEQ ID NO: 913 - DNA, 201 bp, Homo sapiens
atatgtgaactcagtgtctcaatggacacgtagtattttgccaggcaaagaagtagaagttccagcacctagaaataataaatacttgaggtgatggatayttaaatactctgacatgattattacacttgccctatatgtaagatgtctcacatgtaccccataacattatacaaatatgtatcaataaaaaaaagaaaa

SEQ ID NO: 914 - DNA, 201 bp, Homo sapiens
tcattcacatttaatatcccactgttcactcttccttgattccatttgcctaaatatgtctagaatcttcccctccttattgccaccttaagccgtaactrcatcatctcttacgtatgtaattacctttgaattcttctctctgcctccattctcatttttatccaatccatctttcagccctgttatccaaaagatctt

SEQ ID NO: 915 - DNA, 201 bp, Homo sapiens
tctcagttattcccacgatcttataaatgctcaatatgtgttccttgtgtcccacagcagacatcaatcccatggtccactacagatcctttgtagcctakcaacatggatggcagagacagcagttacaatgtcatccttcatttcctcaaaaccagtggatacaaacatgagcttcttgacatactgcatgctcatata

SEQ ID NO: 916 - DNA, 201 bp, Homo sapiens
cttataatgcgcttccaggtcctgccacgcagccctttgtgagctttccaagactctcgctaatcttccctttgctcgttctacttcagcctcacggaccyccttgcttgttcctcctcaaatatgctcagtgtgttcccagcttagggcctttgtacttgcttatcctctgcctgaactgctctcctacagatacgcata

SEQ ID NO: 917 - DNA, 201 bp, Homo sapiens
tgggtgatagaacaagaccctgttcccccctcaaaaaaagttaacacctatgcagtgcttaggcctagtgtgtgcccagcagtgttcaagtcctttaactrtactaatacatttcatctttgtaacaactgtctgagataggcactgttattacctttggttcatggatgagaaacaagtcacagagagatgttaagtgac

SEQ ID NO: 918 - DNA, 201 bp, Homo sapiens
tacctatctcactgtaaccatggataagatcttaacttttaaaataaatgactggtcagtgaacatttgttgagtgcccactgtgagcagagcatcctacyaccattaaacgttacttgttttcacaatttattttaggtcaacctagtttttccagggcttgggagcaatatgaaaagcaaggctgaccttagaaagaac

SEQ ID NO: 919 - DNA, 201 bp, Homo sapiens
attagtctttctaattctgttctttcatttgtttggttttcatcagctcagacaaaaattccatgactaaatttaaaattagttgatgccaatatgtggtkctgggaccttagggaagatgtcttattctctttatgtcttttcccattcccccgttcctgatatctatgaaaatatttagactggaagcagtaataagca

SEQ ID NO: 920 - DNA, 201 bp, Homo sapiens
ttttttttaaaatgtgattttgaagtcagtgataagatcctagctaagaagccacatttgacatgttcatttggagattttcaaagttgccattttgtacygttcaccaatttggatgctcaatatttgttgaatggatagtctattcattcaacatgtattgcctcttactatgccccacattttttggatggtggagat

SEQ ID NO: 921 - DNA, 201 bp, Homo sapiens
cagaacacagtgctaagacctgaacttgctgctgggttccatggaaaagcctagaggcctaaactttgacaaccactgccatgtgaaatgctaccccggckatagacaaaaaaactatgtctgttatatcctggaatatgtgatgctcattttacttctatattaaatttttttctccttcctcatttcaacttaccaaaa

SEQ ID NO: 922 - DNA, 201 bp, Homo sapiens
atatcccactgttcactcttccttgattccatttgcctaaatatgtctagaatcttcccctccttattgccaccttaagccgtaactgcatcatctcttaygtatgtaattacctttgaattcttctctctgcctccattctcatttttatccaatccatctttcagccctgttatccaaaagatctttgtaaagcacaaa

SEQ ID NO: 923 - DNA, 201 bp, Homo sapiens
gaaacataagcagaaatactcaaaggatgttgagaagagagtgaacatgcagtttgcctaaaggaaaggcatccccacaggagatgatggagcgtatgccrgagaggtcactgaatcttgattgtatgccagctaaggcatctgaattttattctgtttgagcagagaacagacatgcacaaatatgtgttttagactgta

SEQ ID NO: 924 - DNA, 201 bp, Homo sapiens
acccggagtaaatgatgccattgccctatttaatgttcttacttcttgttgcctggtgtttagcaaagtccttgacacagttctcaaacattaatgggccraagaatcacatgggatattggcttaaatgcatgttaccaggctccctcccagaaagtctgatgtgatagttccaaggtgggtcccggggatgtgctcttt

SEQ ID NO: 925 - DNA, 201 bp, Homo sapiens
gtggaagcctgttacccttttcttttggccagtttctccctcttggaatgggattgttttcctataccaccattgttttcctgcctgtatcaccatcgtamcttgggagtaaaatccttgtttagatattactggcttatggctgaaaggaagttgccttgagtctcaggtgagactttggacttttgagttgatgctgga

SEQ ID NO: 926 - DNA, 201 bp, Homo sapiens
gatactcaacctgtaccacagtaattttactgttgacttttacgcctgagatgttaaaagtgtgcttttcccaacaggtgtgaacttgctggcttttctcrtcattgtgttttcctatattactatgttctgttccattcaaaaaaccgccttgcagaccacagaagtaaggaattgttttggaagagaggtggctgttgc

SEQ ID NO: 927 - DNA, 201 bp, Homo sapiens
ccataaattctgggaaggcagaaacctatagtatgatttcctaccccagcattaggacaatgaccagtacataataggtgctcaataagcctttgttaggwtggatgtactaaaccatttccactccttgttagcttttaaccaatacctgtttaaaacattcatttaatttacgtcgtaccttcaccaccattacccacc

SEQ ID NO: 928 - DNA, 201 bp, Homo sapiens
attaacttggagtcgaggtaaaacatctcaataggaaaatacacagttccattattttcctcaagatattgggaaaatgacattgcagattcagaggcackttttcacttgaaaaaaaaagagtgacagcataaacaagaacaatcagatcatttcagatacataatgatagggtacagatatcccccagggtgttaggag

SEQ ID NO: 929 - DNA, 201 bp, Homo sapiens
agtcctaactatccaaaatgattaaaagcaaaaagtcattcactccattcagcgaaatgaatagagaagaaaatgaaaggatggggattggggagacatayttaaccaattttcatatattccagaatgatctttatgcctgcccctcatgtagatgtaatatgtgaacacggctgaaagagatatttttatctcctatta

SEQ ID NO: 930 - DNA, 201 bp, Homo sapiens
tttgaaacagaaaatcttttggttgtcattgtccgatcttctgcatttcatgctctcccttagatattcttggttcctcacctcctttgaatttcttattyctacccagccctgctctttgtaagccaataagaaaagggttggacataatacataattcaaaagtaataagattttcaagaaagtgaatccctccaaaat

SEQ ID NO: 931 - DNA, 201 bp, Homo sapiens
agtccttgatcatcttacgatttatttcctaatacattttctaacaccaggagcataaataaggggtagaccctgagcctagggtattgtaattttagcaycaatgtgtgtctcccgttcttgaaaagcatcatccgtggtccatgaaccaagtctttgggaaccatgtaagagcccgcactttactgtagtgcagtgagt

SEQ ID NO: 932 - DNA, 201 bp, Homo sapiens
caaagtaattgctttgggttttcattgtcgtcaacagggatctgtctagcaatacgataacggaactatcacctcacctttttaaagacttgaagcttctrcaaaagctgtaagttctacttctcaccataatcagatttaaagggcaatattttgagctttcaaaataataataccttcaaacttcttttcctctctcat

SEQ ID NO: 933 - DNA, 201 bp, Homo sapiens
ggaaaaatgtcatgatcacagttgacaaagcttcttctcgcttgcccagcttcccatggcgttgtaagaaatgctgccttcactgacctaaaccaaccctrtccccaccctccaagaagtctggcatttactggttatggcatgccactgacagtacctggggtcacccaaaagataggccagagttagcctatctcagaa

SEQ ID NO: 934 - DNA, 201 bp, Homo sapiens
attcatctacccgaagtcctcctctgtgaaggccggtggagtagccactttgaaaacagaacttccaaccaggttaccatgtctaacctatgaccagagastcacactgatgaagcctcataccatttgccttttggattttatttaatatcagaagagatgaattcttaagatatttttctgaaggttgcccagggcaca

SEQ ID NO: 935 - DNA, 201 bp, Homo sapiens
gaaaaattgtcttctacgaaaccgtggggactgttgtcctgcgagatcaccaaatttaatgtcaagagggtctccagtctggaatgctctaaatattcacrgtggagttgagatcatttaggcatccaaaaaaaaacaaaaaacaaattcctaaatcaaaattaaatcttaattgccagatgaatgtgttgcttaactgat

SEQ ID NO: 936 - DNA, 201 bp, Homo sapiens
atcccctctaaactaacctcaaaatctcttgttacaacactattaggtggtgttgtgtttattttctgatgtttatttttatgtatttatttaaatatatrctgtcaaaaggcttctaaaacagtagaggtctcacgtaagtgtgccactattaaaaacggaaataatgacctgaacaccatgagaataagaataggtgaa

SEQ ID NO: 937 - DNA, 201 bp, Homo sapiens
cagctaaccaaagaacaacagtaagcaccaggtaaaaattaggtaacctattgctagcaaaatttaggaatgcagagatcaggaagattaacatgcaatcrttttaccacagatcacagactagtctcttcacataagtgtaggtctactactgcctacattattctctaaaccagacgtaaatgcacgggaatgtctagc

SEQ ID NO: 938 - DNA, 201 bp, Homo sapiens
tctgggactcaagcaatcctcccacctcagcctcctgagtagttgggactacacgtgtgagccactacacccagcgaattttttgtatttttagtagaaayggggtgggtctcaccatgttgcccaggatggtctccaactcctgagctcaagcgatctgcctgcctaatactctcagtgttaagattacaggcaagagcc

SEQ ID NO: 939 - DNA, 201 bp, Homo sapiens
attttacttctctggatcccagcgtagccatttgcaaaacgaatgtgttcattcattgagatggatccgttcatttcagtctccctgcctgcaatggtgakctacatctgcatcttcctatttcctttccctgtctttgaaatccagtagagaagcccagaccgcacaatgggaacatcccacctctcagatggcaatgct

SEQ ID NO: 940 - DNA, 201 bp, Homo sapiens
ttggcacaggcctgtccaagacacagcggagtagggcaaggtggtcagcactacttacagaattgctgaggtctcttccagagctgtgggtgcttgcaaartcaagaaaacaaaagcttggatagcaagaggcagcacatttcagaggaacggaccccaagtggagagtcagcagaccccagctgaccaatcccaccactc

SEQ ID NO: 941 - DNA, 201 bp, Homo sapiens
ggaagagacgttaaatctggttcaaccgatgctcaaaagtgaagtcacttgtcagctctgcctggaacctgctccctgcttccctacccagagctttatgwttcatacagcagttcctccagtaggagagcgagaggggatgaatgggggcctagccatctgggatgacggggcaagcagttggatccattttttccaaaa

SEQ ID NO: 942 - DNA, 201 bp, Homo sapiens
ctctaaagaaaaattgtgcttcgtggcacatgagtgtttaacaaacacgaacttcacatatagatgcacagaatgttaaagcacaatgggatttaagaggycatctaaccaaagtctcattttaccgatcagaaaactggggcccagagagaaaatgaagcccccagcccctcagccgtcagcatctgagctggcaccaga

SEQ ID NO: 943 - DNA, 201 bp, Homo sapiens
cccttggcgggcacgaggtccagtctgagcctgggcccaagccacacaccttccccggcataagatgggcagcgctgggcttccctcccaagtccaggggrgtgcagggggagggctgacggagctcatacagttttcctttgtggggtgcagggtcgggggatggtgcggcaaagccctgcccgaggcacacaatcatcc

SEQ ID NO: 944 - DNA, 201 bp, Homo sapiens
aggcctgcacatctagagtggctgacaggagcctcatcactgagtgaagatgggaagctggagaatccaagaataataagaaagagtctggttcattagcycagactcagatggaagaggagaaggagaacggcagctccaggtgcagcacagtggctattatggaaaccggccacactgtgggaagaaagtgccaggtaa

SEQ ID NO: 945 - DNA, 201 bp, Homo sapiens
gtctcccatacaatgggagtaggatgatctttaggccttgtcctgcgaataggtcacattctctgcattagacagagctggtggccagataggaaaccccygtgagaccatctagacagaaaacgtgcaggcccccgattgctgtttcagccatgctcaagatttacttaaagacaatccaatgaagtgatcagaagatca

SEQ ID NO: 946 - DNA, 201 bp, Homo sapiens
gtccagggagaaagtacagagtcagtgactcattgagttcactctgcccttcttccctcaggtcagacactcactcttccctacgccccacagatgcaccscaagagtaagtggaggccaagccagcccgacactcagtcccctccgcttccgacctggtggcctgtgctgcctggttttccacaatggagttccgggtga

SEQ ID NO: 947 - DNA, 201 bp, Homo sapiens
cctacaggcgccaatccacatccccccaccgcagagaggtggctcttcctgcaatccggccgcgatgcgcctgctgtaaatcagcgtggctccccccaagycaaaggccgtctgaacaaggtgacagagaaatgcaaggaggatggacagcctcgtctggctctgccttggagggggaggctgcctggcctcccacagccg

SEQ ID NO: 948 - DNA, 201 bp, Homo sapiens
acagatggaagatagctcagtgctgtgtgaagggaaacggcttttgtttcagcccccggtgtgtgtggcaggcacgaggcttgatgacagggtgatgagcwgtggaaggaatgcaccacagggctggaacacaatcgtgctttgtttttgttcttgcatctgagaatgcccctggactgatggcagcgacgaggcccaatg

SEQ ID NO: 949 - DNA, 201 bp, Homo sapiens
actggggaaaaaggtcggtcgctaagtggacagtttgatgcgctctgtgcctctctgagcccttcagaaaacgaggacaccagctgtcccctgtctcaatygagcaggacgtctcctttcatttctcctgggcctcttactccctagcagggtgtcagagcccgctgccagttgtcccaagatggggaagcggccccgaca

SEQ ID NO: 950 - DNA, 201 bp, Homo sapiens
aaatgctcaatgtagactgttttaaaaccttgaaaaataagtgggtgtttgtcattgttcttttaaaaatgtgaaaaggaaaaaacatgagattagaatcstaagctcttcacccaatttcacaattcaccctgactagcaatttgctggactgttctaaaatttttttcatttgtttcttttttaactatgtgttttgaa

SEQ ID NO: 951 - DNA, 201 bp, Homo sapiens
cagggctgcagaggaagctctgagtttctcagagaagcctagcactcccttctcttccttctaggcagccaaagtcctgggaggcacaagaaagtgagttmcaagttccactctgtcccacagggaggctgcaaagtggtgtcatctctcagaggaagtcggctgagctggctggaaagtgtgtaagtgtgtgtgtatgtg

SEQ ID NO: 952 - DNA, 201 bp, Homo sapiens
gaatggacaagaaagaaaagacgggaaaaaaagggaaaaagtaaggacatttttaaaggggggagaagagatggcaaataagaaatgatgttggcagtaayggcttttgagagccttactgattgatagaaaatatttcttagataggtttcccctccaggagaggactcttggttcaagctccctcctctcatgctggcc

SEQ ID NO: 953 - DNA, 201 bp, Homo sapiens
aaaaaagaaagggaatggacaagaaagaaaagacgggaaaaaaagggaaaaagtaaggacatttttaaaggggggagaagagatggcaaataagaaatgaygttggcagtaatggcttttgagagccttactgattgatagaaaatatttcttagataggtttcccctccaggagaggactcttggttcaagctccctcct

SEQ ID NO: 954 - DNA, 201 bp, Homo sapiens
cagggtacctcccctttacaaaaccgtcagaaaaaagaaagggaatggacaagaaagaaaagacgggaaaaaaagggaaaaagtaaggacatttttaaagsggggagaagagatggcaaataagaaatgatgttggcagtaatggcttttgagagccttactgattgatagaaaatatttcttagataggtttcccctcca

SEQ ID NO: 955 - DNA, 201 bp, Homo sapiens
ctgcacatgtatcccagaacttaaagtaaaattaaaaaaacaaaaacaaaaaagagagtgtgtgcagggtacctcccctttacaaaaccgtcagaaaaaaraaagggaatggacaagaaagaaaagacgggaaaaaaagggaaaaagtaaggacatttttaaaggggggagaagagatggcaaataagaaatgatgttggc

SEQ ID NO: 956 - DNA, 201 bp, Homo sapiens
atcagaatgtctgggggtgggagccaagacccacatattagtaagctccccttggtgatactcacataggctgaaatttaagaacgattctccctctgccyttcaattgctattggatgattagtaccatgtcccaccctcaggagcaaaagtgaattgctagcacttctggacccaaggaggggagacagcctttgaagt

SEQ ID NO: 957 - DNA, 201 bp, Homo sapiens
tcagcctccctcatttcttccacaaatgcaagcaagccactccctacttccctgccagaataaaatgccaaaaaccagagaactaagccccactccaggckgaagaagtgcagccccagcttactatcagataagtcgtttcctaaaaagaaatgcggctgcagtaaggcaggaaagccgggagccagggaccctgaggcc

SEQ ID NO: 958 - DNA, 201 bp, Homo sapiens
ctgacactctctacccattaaacaataactcctcatttctccttaccccagcccctggcaaccttcaacctattttctatctctttgactttgactactgmagatacctcacataagtggaattatgtagtatttgtctttttgagactggcttatttcacttaacatcatgtcctcaaggtgcatccacattgtagcatg

SEQ ID NO: 959 - DNA, 201 bp, Homo sapiens
gaatcttgcagaattaacttcacataaaggattcaaatgaaccacttattcggaagaaaacatcccaggtttgctggccagttcagctctccacactttgyaccaggagggatcattctaaaaagtgatcccaaggggagtgagccagatgcagacatttaactgttctgcaagataaggacttgaaagcatcttataagt

SEQ ID NO: 960 - DNA, 201 bp, Homo sapiens
tgagtgcatcattttcttttcgcaatggaaaagcaaagctagtttaatggacgacgacgtcaacccaatagtgccaatagtgggtgggggagagtttcgcrggcagggacaggaaaggtcctggagtgctgcccaactctccccactttagagtcacttgcctttccccagggagccccaccaggccatgctctgccacac

SEQ ID NO: 961 - DNA, 201 bp, Homo sapiens
cccgttggtagcgctccaaaaacccctgcctgccagcacagagacaccccgaaagagtctgctgggtttggccatcattttggatgataactcttaaatcrgattggagacaaaggttgtttctttcttccttttcaaaatgacttgggggaaaaaaaaagatgagctacaactattgcaaagactaactttaaatcagat

SEQ ID NO: 962 - DNA, 201 bp, Homo sapiens
ggccaatagcactcagaccgcactgtagctccagttgtcccaaaggccaggtgcccccaggcagggcacaaactgcatgactgctcaaggtggccctgccraaaagcattgatgcattgctgctcctgcttgcatgtgaaaatcctagacagggcagcatctttcagtcttctctttggagctcaagaagcatggggaagg

SEQ ID NO: 963 - DNA, 201 bp, Homo sapiens
aaaaaaaaaataataataataaaagccttattctagtcttcagaaacttactatgtaattgcaaaataagacattcttagaaaatgtcaaaaacactacartgcaggtaagttaagggcaaagcactcagttactatatactcagtgcaaagtgcattaaattgatggtaaagacacaaggttcagctgtgccatgaaata

SEQ ID NO: 964 - DNA, 201 bp, Homo sapiens
aaggcatcaaaatcaactattgcaaactggcattgtataactttttaaattcagaagttataaatggtatgggtgcttaattatcaaatcacctgcaattytacttgtctgtcacaatggatacctagatatgaaggttttaagatttaaaaaaaatttaaacataaaagttaaaaactatcattattaaagtttctattg

SEQ ID NO: 965 - DNA, 201 bp, Homo sapiens
ttgggtccagatgaaaacactggactggcttaggtcaaaagccctgttctagccttgtgctacaatgaaagagcacactgtggaaggctagatgaccatamaaacacatgaacaaactacacatgaacaaactttttaaagtctagtctattagtatataaaatcaactataaaataaacaattaatgataatatttacta

SEQ ID NO: 966 - DNA, 201 bp, Homo sapiens
tatttgcactaaatctcacaaatatacagtgcttggacttttcaaattatgtatgctttagaaaactataaatcctccacagaaaatgtcaagttaaattrgtcaaattgctggaaaataaacacacacacattttcaaaataaggtgagcaaaaagttgaggaaatcctgtaagaaacataacttgctaatacccattac

SEQ ID NO: 967 - DNA, 201 bp, Homo sapiens
tcaaccaatcccaaaactgccagccaggcagaattatccaaggccacatccaggatgtactatgggttcatcctgacttcagatcagacataccctgcatkgggaaaaataaaccaaatttgaaatacattttgaactcaaaatgatcatctatgggggcacttactaaaaatatggttattctaaagctcctaatacaga

SEQ ID NO: 968 - DNA, 201 bp, Homo sapiens
agcagtgatgctatcacagctcactgtaatctccaactcctgggctcaagtgattctccctccttagcctcccagtaagttagctacaggcgcgagtcacyataccagggtaattttttaatttttgtagagatggtgccttgctatgttgcccaggctggtctctaactcctggcctctagcaatactcctgccttgtcc

SEQ ID NO: 969 - DNA, 201 bp, Homo sapiens
aggacatttttatgataaggaaaaatagagagcgggtagaagggaaagccttggccaggaagaggaatattacttctgaaatatgagggaagtagagttgygggataacccaaatatttcaaacaaaaagagaaaataagatagctcccactgggatggccttgggctttcctgtaaaacagaggatgatataatttgatg

SEQ ID NO: 970 - DNA, 201 bp, Homo sapiens
agcagaaccctttgaaatcaaagtcacagtcactggagaagtcatattatgacagaaactgaaggtgtatttgccacaggtctgttcagaggggggaaaaraaaacctggatttttacttcaaatattgaatatagccaatatccaaaataccatcatcagatttctaaagaactatttaacttaaaagtatcacttcaat

SEQ ID NO: 971 - DNA, 201 bp, Homo sapiens
aacttccctacacagctcataacaacctggtcttggataccaacgccctttgtacttacccgttcaggcagatgagatggaaatggaatcaaactctactmcacacaaatgacgtcacgagagaaaaaaagattggaagaccacaatttgtttccatatcttgccacaccttgagattcgttaccaggagtaacaattcaa

SEQ ID NO: 972 - DNA, 201 bp, Homo sapiens
ggagagaatcctctggagtctgaaggttggacactgggatttgtttggagaactcaccaacagaagcatgcagcgactttcttttatagcaccgcagcatsccaggaagcccagaatcatgatgatggcacctacagcaatcaatatgtccacagcaacgtaggagctagagcctacatcttcagaaccaaaaatctgaag

SEQ ID NO: 973 - DNA, 201 bp, Homo sapiens
tgcttcagaactttgtatgaagcgagaaagtaattacaaatatcttagatttttcttattgcatggtgacagaataatcaatcaaaatctgcaaaatggaracatttttcaatctttaaggaagatgttaaaaactaaacaaacacagaagaactatgtccaactctttaaaatgaacaatgaattctaattacctcttct

SEQ ID NO: 974 - DNA, 201 bp, Homo sapiens
ttatctttaaataaggatttttttaatttgggaaatttctgagatttttatatcatgattcccatggtactccatgcattttaattttttgtagggacttyaattgtgaaaagaaagtaacagaattgcttattgtaccaaatgtgatttagttctcacctctttgtaaacttgttttccattatagctttggcatggtct

SEQ ID NO: 975 - DNA, 201 bp, Homo sapiens
cgctcaaaagctttgtgttttcatagagagtttcattcacaatgcgatcagactgaaaattgaaaagtattttacattattcacgccacaaggtagtattycaatttttcaaacttcttcaaaattttcaaacatctgtgcacacaccttagatttgaaaacagctcctaggatacctgtcgccacctgcaggagcaggat

SEQ ID NO: 976 - DNA, 201 bp, Homo sapiens
agacattttaaaaagacagctgctcctgacttatatagcacttacatatttaaatttacaaagccaaagcaacattttaaaggggtttgactgacgatagsttgatgcatccacagattcatttgttcccgatctggcaatacaggaccatagaaaacaccaaacccagtatctagagaacaaaataacaggattaacatg

SEQ ID NO: 977 - DNA, 201 bp, Homo sapiens
agcttcagtagagtttctgtcagttggtactgggaatccttagagatatataccccttatcagtaagatccccaaactctttgattttaccttattgagcrcagataccacattctatcttgtttaccctctttcccaaggttttaagttccatgagggtaaggatgccttaccattatttcttgtgtctcacagtgcctt

SEQ ID NO: 978 - DNA, 201 bp, Homo sapiens
cacccttagatgtttccatcactttgtcttttgtgggctgccttgcctgcttagcctgaattctcttcaaacatccttccagtcacataatattaattcaytagcatcagagaagggcttcaggggaagggagagtgaaagagcagagaggacagaagacagaggaaagtgaaaccacataaaatgggcacagtaccaaaa

SEQ ID NO: 979 - DNA, 201 bp, Homo sapiens
tttgaagttggccaaagtatcatttccacccctaactcttatcttttcttcaaacttcattttaaaaatgaaacaaatgtttagagtatatcattctcatytgagtggagaaattcccatgtaaatatcagtctaatatcatgaaattattcgtaactttgttgaatgactttgaaagtcaatttattttctatcaagaat

SEQ ID NO: 980 - DNA, 201 bp, Homo sapiens
caagtcctgtggaggcctgagtcatcagttcccttgccagagtggtttcagcagtatgaagtgcagttggagaagttacctgaaaagtgagtgggcatagstgggtaaaggtagcagaatgaaaccattcatttacccatcctctcttctatatccacccacctaacagtaaaggaatttttaaaacccttaccctgtgat

SEQ ID NO: 981 - DNA, 201 bp, Homo sapiens
ctggagaagaagataaacatatcaagatacctctgcaattccaaccccacaggagacagtgaacctgctcacacacctaccacgttgccactgtcaccagmatctgagaaagacatcatacaaagactctctataaccaagaaactcatacagagtctttacaaccctgcaagcaccaagagccaaattaggccacattaa

SEQ ID NO: 982 - DNA, 201 bp, Homo sapiens
ttgtaaagggaagcactcaatatatggaaactaggataatatgagtttatatagttccactgtccactgggaatttcagagggatgtgaaaatttgttccygtataaaatgaattgatgagtttcttaccctatggacaattaagattacaaggttgttcatgtagaattaaactctttattaattatatcaaagcctgta

SEQ ID NO: 983 - DNA, 201 bp, Homo sapiens
actccatttcaaaatctcttatgtagagattgtaaatccgaccacatatgctggtggtaggaatcaccaaggcacgttagttagaaagatctaactgaaawctacagcatcagaaagacttgtctctgttatcaaagaaacaaacagataatgtaaccataaaataatcagagctctggccaggcgcggtgcctcatccct

SEQ ID NO: 984 - DNA, 201 bp, Homo sapiens
ttaggaatgtgacaaattgctaatttcctatgaaggattgtaaaattccaactgagagctcagagctgagcatagacgggagagtagatataggaaccttycctaacctcagagattcctcctgctgcctatatttgaatttaaaatattgatgtcacctcttggctaagaagttatcactggtttttataattgttgctc

SEQ ID NO: 985 - DNA, 201 bp, Homo sapiens
aaagtctatgcttacagataatgtttcaatttacgtattttgaaagcttggttaagtcctaaagatttttgtttgttggtttttattgttttctcattaayattagagctaaaaaatcagttttgttaataaacaggcaggacattggaatcaaaataaatgtgacaaaaatagaagtgttaggaaactagctctatggac

SEQ ID NO: 986 - DNA, 201 bp, Homo sapiens
gcctatgaaaaactgaagaagagaaaaagaaatatacattatcctcagtgcattcagtaacatctggggacattctggcacagcacttctctctacagctrggattatatcacagtgagagtgtcagtcacactcttcatttattccactttttacttcaagctgaaaattttgggttcattactactcagaaaattgctc

SEQ ID NO: 987 - DNA, 201 bp, Homo sapiens
agaggataaaataaacttttatgttagtttgtactttgcctcccattgcagtagaatgtttctttgacctattaatattgggcttaaatgatgccagactmatagaagaaatgaagtctatctgcttttatctttaaataaggatttttttaatttgggaaatttctgagatttttatatcatgattcccatggtactcca

SEQ ID NO: 988 - DNA, 201 bp, Homo sapiens
ctgtgcaaagtatgaatacaattttttctttttcaaattctatttagttgctttaacattatttattgcacctcatgtatccccatgatttaagatgccayttttaccataaacaaaatttttaggtggctttgagtctatttataaaattttttatctatttattcctcaatgtcatattgttttaagtatagaggcttt

SEQ ID NO: 989 - DNA, 201 bp, Homo sapiens
agtcctatgtgaaactttccattgagcgaaagtaaaaaagcaaaaatctaccctgaggatttgtaaccacaagtcatcactcacagtagtttatgagctgmattagcgctacctgtatggtctaaaaaaacctcaaacagaggattttatttaaagtggtcacaggttgttggtatcttgataaaataaacagaagtaaac

SEQ ID NO: 990 - DNA, 201 bp, Homo sapiens
tatttatttaggacttccataatttatctcaaaaatgttttttagctttcatcatagtggttttcacatatttcattggatttaatcttaggtacttggtrtttttgatgctgctataaaaggtatagtttcctatttcattttctacttgttttttgtcaatatattaaaaactatttcttattggtattgtattcacca

SEQ ID NO: 991 - DNA, 201 bp, Homo sapiens
accaaacttaaaaataaaaacagatcatatgagaaaagaaaaggaggcagagacatcagtggccacacaatacaagagagaaagttttcactgaccacctyagcaagtttcttcaggaaaaaaatgtcagaatctagcattgatacaatttactaatctaaaatgtcagcttttcaacagaaatttatgagacagagttta

SEQ ID NO: 992 - DNA, 201 bp, Homo sapiens
aaagcactctagatgatttaaatgtgcagccaggtttgataacaactgctatgagctattcattcacttattcaatcattcaacaaatatatgttgcgtaycaactatgtcctagtccttttctaggtaccaaggattcagaacaaacattcagagtgtctggaaaatagttattaaagttcacaggtgatattggatggg

SEQ ID NO: 993 - DNA, 201 bp, Homo sapiens
tattgtttcataacagccagtgtctaccagtaatttgaaatctaacaggattttgtaacaataaatagggaaagatttactttttgagaatgcataggatratataatagtgatagcaaacaatggtgagcactcaataatctgagcaaaccattttaacagtttatgaatgattgtcttttcctccaggtcaatgtttct

SEQ ID NO: 994 - DNA, 201 bp, Homo sapiens
attaagaagacatgcgtaccaaatgcaatgcaatttcctgggttggatcctgaacagaaaaaggacattagtggaaaaactggcaaaatccaaataaggtycatagtttccttaacagccttgcatcaatgctagatttttagttttgataaatgagtcatagttatataagataataacattaggggaagccaggtgaag

SEQ ID NO: 995 - DNA, 201 bp, Homo sapiens
tttccttatatagaaatttaacaacactaataatattgttgccaacccataataagttagaaaaaaagaaagggcccactagacaaagacaacttataaargacatttattgatgtgtgggacaaagtcgaggttctattgatgtgtggggcaaagctgaggttcggatataccttgtataaatgtaagtgatcttatcac

SEQ ID NO: 996 - DNA, 201 bp, Homo sapiens
acagattcagaaggaaggacggtaaagggaaaacaaaagacagcctctgaacaatctaaaacaaggactcaaatttcatgcactttttccagtttgaacckctgaagccttccctaagactgtttacttttccttatatagaaatttaacaacactaataatattgttgccaacccataataagttagaaaaaaagaaagg

SEQ ID NO: 997 - DNA, 201 bp, Homo sapiens
ctacacaaatatagaaacaagcattgtgaaatttatacatatggttctgttggttagactaacatggaattctgtttttgttcagtccactttttcctacwcaattgtattaaacctgcttctctttgtgctgtgcaggatgaggtgtttacctgacaaaaaatcccaattgtcttcaaagaatactttatggataacaaa

SEQ ID NO: 998 - DNA, 201 bp, Homo sapiens
gcataaaatctggaatgtgaaagttaagaactacacaaatatagaaacaagcattgtgaaatttatacatatggttctgttggttagactaacatggaatyctgtttttgttcagtccactttttcctactcaattgtattaaacctgcttctctttgtgctgtgcaggatgaggtgtttacctgacaaaaaatcccaatt

SEQ ID NO: 999 - DNA, 201 bp, Homo sapiens
tcacagtttctgatgtccagcagcttcttctcttcttgatgttcagatgcttctctcttccgtgtgtgtatgagctgagtttggggtctggagttcttatyggcacaggatgggggcatgctgggccaaaaggcaacattcaggtgggaaaacagggaagtaaagttctcatttagggctgtggggcccagctttagggtg

SEQ ID NO: 1000 - DNA, 201 bp, Homo sapiens
ctacctctggcacttttcttgctgctttatttttgcgatttcctcccaaatctactctgtcaccctggaagagtcctgagttatgctgcatattaatgcaytgcatccacaaactgactcattcaataaacatgactgacttattggacatgtactatcagctggcatcacactagggacagatagtgactcagctattct

SEQ ID NO: 1001 - DNA, 201 bp, Homo sapiens
aacagggtctgaatttaccttctcgaggaaaacaaccaaaataatgcaggtgaaatatatgaaacaatagtttttgagatactggaattagatgataaggrcagtgatcattgagggaggggaaacggtgattatcacctcactgccttgagagggtttacagcatgcagtacaaggagggagaacacagaaagctcagag

SEQ ID NO: 1002 - DNA, 201 bp, Homo sapiens
ataacccccatttagtttatcaactgaaggcaacaaagttgctcccaagctggctaaattcaagatatgcaactaggaagttgatttctccctttgccacktactctacccttcccttctaaccttcagcagacttaattctcttagtatttcccaaagtctgatattcatatgatttgtaacacacataatgatgttaga

SEQ ID NO: 1003 - DNA, 201 bp, Homo sapiens
attttttaatgcatgtattttaaaacccaatatcatagatgtgttagagaaaagcaaaaatcaggaaagtattaaatggaggacaagatctggggagtacygccctatcttaactgagatgattttcttcattcatcttacatttttctataatgtatctccttgccatggttaaagaatctattttccccttctttctac

SEQ ID NO: 1004 - DNA, 201 bp, Homo sapiens
atattaaataggactaactcttctatctttcttagtctgctttttgtatacaggcttatacccgatatattatacatttattttttattgcgtttccccaycctaactaaaatgtaagctgcaaggaagccaaagctgatttgttttgttctttgcaaaaacctcaatgcatgtaggagcacccagcacatagtagatgct

SEQ ID NO: 1005 - DNA, 201 bp, Homo sapiens
atcactacacaacaacagcacatcattttcattaacttgaacaaacaaaaccaagcagagattaaaaagcagcacagatgtgatatgactctcttctcctrtcctggactggacagccttgtggagtcacttcccttaacaaggcaggaaatgttctttcagcctgcccccggaaaaacagcacatggcaccaagatacaa

SEQ ID NO: 1006 - DNA, 201 bp, Homo sapiens
cacacaaatcttacctgtctgtggtttcaatccgcttttattaatccctgccaattttcctccctgctacctgtgtttcctgaggtctgatgcccaccgamctcacgttgctgaagttctactgtgtattcccttagagtgtcaggttttcctttgggactcaccttcaaacatgtacgcaacatgttgggctttagcatt

SEQ ID NO: 1007 - DNA, 201 bp, Homo sapiens
tccagattgtcagactgtagcctttgcacaatttgatatttttaataatcattaataaaatatctagataaaacatctatattgctgtgctttgtttcatrcactatgagatgctgagaatgttatgaaaagatttatttttaaaatgctatatcagaatgaaaatatcctttgaagtctaaagtaaattgttttgatttt

SEQ ID NO: 1008 - DNA, 201 bp, Homo sapiens
ataagaagcagttgttctggggtagaacatgaaggctgcactcacattcccccatccatccctgaaatgttataaattcaggagccctagcaactctgctrtagaaatacctactcaatccaaacaagagatggatactagccaaaaagagaaagttaagaccctgagacccagtctcatgtatctgcaaggaacgtaaag

SEQ ID NO: 1009 - DNA, 201 bp, Homo sapiens
gtgttaaaagaaagagcgaattaatttcaacatgattttgcacctatttcctcactgaacaagctgataaaagaacctcatgtgtgttgtttttttctttyatgggtgtttcattgattaaaattcacctcctattccactaaaattaaacccaggtctccgtacaatctttctcatttgcagttttgcaaacatcccaca

SEQ ID NO: 1010 - DNA, 201 bp, Homo sapiens
tcacagctccagctcacttgctctgtttctttcaagctccctacatttctttacaattaaaagccatcaattcatgtgtatcatatgaacccaaccactgwgcgaaatctaaaagaatagagagaattttttttctagtttccttggctaaggaacataattctttcaccttcctgtgttaaaagaaagagcgaattaatt

SEQ ID NO: 1011 - DNA, 201 bp, Homo sapiens
ttctgctcgggttatattgcttgattattaattgttctcagcactgattaccctttgtaatgcatgatgatttgatctgtggattggggacactgcatgargtgaatacatgagagagaaaggaaatctcccctgtggcactgagggagagagactagcagtggagtgcattgagtcctaaaccaggtggcaggtgctctg

SEQ ID NO: 1012 - DNA, 201 bp, Homo sapiens
tcaacttccattacatttatttctatttctattccattatttccttaaggtcactggtgacacacaaccattactaagcaacatagacagcttgtcaggakcacaggcaaatgtgagccagattgtccagtatgaatatctactgatgcaattaatcaagctggcagaccttcctgggaaaacaagtgcctacatcgagaa

SEQ ID NO: 1013 - DNA, 201 bp, Homo sapiens
atgttatcaacttccattacatttatttctatttctattccattatttccttaaggtcactggtgacacacaaccattactaagcaacatagacagcttgkcaggatcacaggcaaatgtgagccagattgtccagtatgaatatctactgatgcaattaatcaagctggcagaccttcctgggaaaacaagtgcctacat

SEQ ID NO: 1014 - DNA, 201 bp, Homo sapiens
cagtagacaggcttccactttatggaaaactagagatttatagtcagcagaaaatgaaaaaaaaataattacgtgagaagacacagtccttggttgtgtaycatactgaattcagtgagttttaaaggaaattttcatactcaatgttgaaaccttcagccctcttcctatctctgtcccagaaagtggtatccagaatta

SEQ ID NO: 1015 - DNA, 201 bp, Homo sapiens
catttaaacaatctttaattgtaccatatatgctaaaaatgataaggtcaatgtcccaacatcccagcctgctcttttcataccttgtttttccattatcyattgatagatatcagttatcaatttgttggttatgtctatgtcaatggactttcaagagaaacataacaaattgctaaaatacaaatcctgtcaattaaa

SEQ ID NO: 1016 - DNA, 201 bp, Homo sapiens
tagaatatcatcactttgaaccacttaatgaactaatgatggattttggcacttgaccatcaatggctacgaacgtcacaaaagagggacacaatcaaacmtccagtgcctcctcatgaaagaatacaaaatcacttatgattgtcgtgtgaaaaaaaaaggaccttgaattgtatcaggctgcaccacaggtatgcaaac

SEQ ID NO: 1017 - DNA, 201 bp, Homo sapiens
actcactcacagctctatggacaagaagttatttccattaggcctggaaagattatttttccatgtaactctagccctgtgtttctgctagattttagcayacaaaagaaaagtcacaacagtttaaagataaaatatccttatcatgcctctgggcttgtttgtgagaagctatgttggaccaggaaaaaagggaatgac

SEQ ID NO: 1018 - DNA, 201 bp, Homo sapiens
gtactgaggctgcataaattcttccttctttaagcctgttttaagctgggctctagagtaagaatgatcccggaaagaagagagtcaaaggatgcagctayaggggagctaggaaaagcacatcagaaaggaagttaaacagggactgacccatatcaggtttcagctttcggaaatgatgctttaagcacaatttttaca

SEQ ID NO: 1019 - DNA, 201 bp, Homo sapiens
aaacaaggaaatgataaccccaagaatcagggcatgtggcacatgatattattagatgggagaaagaaagataattatccctcatgttgcttccatctgcwcaattaaggggaaaacacttcgtgcagaaatgggaggaaaaaaaaatggctgagaaaaacagaaccaagactgagtggttttcccagctctgatacattg

SEQ ID NO: 1020 - DNA, 201 bp, Homo sapiens
attcagctgaattatgtgtgaacttacagaaactatctaatagtttttttagaataattccaggggcttttcagaatctgtcttgaggaaaaacatctttsagttgaatttgaacaggagacaaatagcaatctgcaattgaatttacttatttcctcattatcctaagtggaaactatttttatttactctatatttatt

SEQ ID NO: 1021 - DNA, 201 bp, Homo sapiens
aggatggaggctggtcattgaaaagaccaagcaggactagaaggctgggactttcagctcaccctcagcctccaggaagaagagaggggctgaaagttatygccaatagccagtgatttaataatcatgcttatgtagtgaaactttcataaaaaccccaaaagactgggttcagagaggttctagatagctgaacatgta

SEQ ID NO: 1022 - DNA, 201 bp, Homo sapiens
caggtatccacatgaataactcgctcatttcctctaagtctcatttcaggtatcgctttgtcaatgagtattactataagcattgtgtttcagattgcaamctccctccccaacatccctgattcctattacccttctgaatgtttttcatagcacataatgctttctataggcaatgtattatgtattatgtttcttatt

SEQ ID NO: 1023 - DNA, 201 bp, Homo sapiens
gttcaccatcaatatttcttgaaattaatgaacaagcaagggaataaaagagtcaataatacaagattatactgtacctcaataactgccagtccaaatgmtattccaataactataatcaaattttttgccaagaagtcttttatgaaagaaatacaggtctgttaaaaaaaaaaaacattaaaagttacctctcagaaa

SEQ ID NO: 1024 - DNA, 201 bp, Homo sapiens
cctcttttctgggtcctggagtgctgtcatcactgcagatgcatctgttcctgatgcattcatagacaccaccaatgtggacccaggtaccagaatcagcyaaccacttgggctcccatcgtgccctgactgccccagtgcatgtacacaacagggagcctgagcaactgctctgtacaagcttgcctgagccctcctgtg

SEQ ID NO: 1025 - DNA, 201 bp, Homo sapiens
tcatcagaaaaatgtgggtaactttttcaataataaacccctggacccaccccctggaaaatctgcttaagtatatctggggcagaaatgggaaatttacrtttttcttcaacatttcagatggttctgttggctctttaaaaattatggcctacgggtaacaggatgaagaaataattatttgccaactacggtatagac

SEQ ID NO: 1026 - DNA, 201 bp, Homo sapiens
ccttgctggcacagagagctcgtctagaagaggagatctcagcatttaatatgtatgagaattatttggagagagtaaatttcatttttaataagtacccrtttgttttattgttgtgtacatgacctaagaagcataccttaagaaagaatagtgataataacaggaaataagaatggaatatagatgatggaactcttg

SEQ ID NO: 1027 - DNA, 201 bp, Homo sapiens
aacatcaaacgatttctagctctgtttcaatttagatacttattcaaagcatgtcgaaatgatagaaacctcgtgggtctacataattgagctaaaaaaamtttcttgagcatttttcctcacagcattccctctctgtctctctttctttttctacccctctgttatttctttttcctttccccctctttgcttctttgc

SEQ ID NO: 1028 - DNA, 201 bp, Homo sapiens
tcatgattattctattttttccataaatgtgcatttctatgtttattccctatctgtcaccacactggatgcaatcagatttgtcatcttttgagaaaatkatttttgaaatagttttatgtgaggtcaaggaatgaaatgaattatttttgtagtggagatgagaagagtaggatgttctctcaaaggcacccgtaccct

SEQ ID NO: 1029 - DNA, 201 bp, Homo sapiens
atggagctaccaatggttatctttgctacaacatggatagagtctttcttgagattagcccaactgataggaaggcagagtcaaaataatatagaaagacwgatacctggtagatcgtttgaatacctgatcagcctaaacctagtgctactttttactctgcagttgactgaggccagtaaattctcatttgtgttttaa

SEQ ID NO: 1030 - DNA, 201 bp, Homo sapiens
ttgctacaacatggatagagtctttcttgagattagcccaactgataggaaggcagagtcaaaataatatagaaagactgatacctggtagatcgtttgartacctgatcagcctaaacctagtgctactttttactctgcagttgactgaggccagtaaattctcatttgtgttttaagtcagcttcagtagagtttctg

SEQ ID NO: 1031 - DNA, 201 bp, Homo sapiens
gatatatacatttttctaatgatgttgatccattggcataattttattgggcctcagattctaagtaaaaaaagaaaagaagaagttagtgttctgtgagwttaacaagttttaaaacaaacaaaagaagtagattgtgattgaatatctcttattgcaaactgcgcagaccaccaagctcagtaaaagcattgagtaagt

SEQ ID NO: 1032 - DNA, 201 bp, Homo sapiens
tttagtctctagacttgttcgtcctacattatcggctattttccatcctctgactacatctccctatttcctccccaccccatgccctttcctgttaaccrctgttttgttctttatctatgtatatttttagattccacacataaatgagataatgcaattatttttctatgtctggcttatttcacttagcataatgtt

SEQ ID NO: 1033 - DNA, 201 bp, Homo sapiens
cacaaggaacttcaggcacaggatttctttacaagagcaagagcacttcaggagaacatgctacaacaaacagcacatttagaaacccaggattggcatgragaccttgaatccagggatacgtgcagcagatgttactaggacccaaaccagaggctcagtgattacctctagtctattttgtcctaggtcatcaccctg

SEQ ID NO: 1034 - DNA, 201 bp, Homo sapiens
gtggaatatggccctgaaaagagtcaattactagtgctgattatggtaatgaaacaaaaatcaagaaaaactttaaaatgatggctcttggccaaaattayatagaagtttagaatggaatatttagttaaggattgaaaatgttattttatagtttcaaattatagtttattgcattataggagagaaattcaatgagct

SEQ ID NO: 1035 - DNA, 201 bp, Homo sapiens
tgccatgtaagaagtgcctttcaccttccaccatgatcatgaggcctccccagccactgagagtccaataaatgtatttcttttataaattgcacagtctyggatatgtctttatcagcagcatgaaaacagactaatacaccagtgtacaactcattagtatggctaaaatggacaagacagacaatacaagtattgcaa

SEQ ID NO: 1036 - DNA, 201 bp, Homo sapiens
acacgaggatcttcctgttctgcctgatcacagctccagctcacttgctctgtttctttcaagctccctacatttctttacaattaaaagccatcaattcwtgtgtatcatatgaacccaaccactgtgcgaaatctaaaagaatagagagaattttttttctagtttccttggctaaggaacataattctttcaccttcc

SEQ ID NO: 1037 - DNA, 201 bp, Homo sapiens
tcccctgtcttgccctttgcttctggggccactcccactgtagctatttgcttacttattaaccttccctagtaggttctaaaggtcttatgtattatttygcacaatatctgacacatagaggtatggcagtaatgttgaatgagtgaatgaatgaatggatgaatgattaaaatttgtctcctctcagagtatcctcca

SEQ ID NO: 1038 - DNA, 201 bp, Homo sapiens
tatttgtgttaaattttggtgttcactttggtttattttacatttaattctgcatatgtgaagcacttaatttaaaaccatataaaaaagtcaacagaacrtacttttgtgggaatatattccaggaactctcactctcattcttatcccaccacttcattttcatgcttcctttatagataatcattttcattgatttct

SEQ ID NO: 1039 - DNA, 201 bp, Homo sapiens
ctgaattacagatcaggtgaaaagcaggtgagaaaaagtccctgttctgttaaaaaaaaaaaaaaagccaacttggcctttgcatcttgcagcaccaatgyatgtagaccatggccataatgaagacggagagctggacaattgctttaagatgccagggttacccatcagggtggataagcaaagacaaggtcttctttt

SEQ ID NO: 1040 - DNA, 201 bp, Homo sapiens
gtaaatgtttatcaaccagctctccagaaaagaaagaaaagaaaagaaagaaaagccctgaatttacagcatttgttagtttctatggcataaatactccragcatggtagatttcaaggtaccaatctcatgttactgaacacaaagttgggaagaactttgtgtacaaaacttttgtgtatatgtgtacaatctgctta

SEQ ID NO: 1041 - DNA, 201 bp, Homo sapiens
aaattatagaatcacaaatttataaataatgagattaaagggaacttcttggattataactcaattttctgtttcttcagaggaaagagtcacatgatgaycgactgttttgagcaattagaaaaggaatatcctgcctttcctttctagggccacctacttcctagtcacaagaaactgaaaacaagtaaaaaaaagaaa

SEQ ID NO: 1042 - DNA, 201 bp, Homo sapiens
gtaggggcaggtccttggtgaaaccccacctccaagccaaaggcagtttaaagcctgaaatccaagctcaaaccggattgagaacttgtcttcccatttgrcatgctttcctctaattgatccctacccttcacttattttacatatacctgccctttcctaattggttttctacagtgtcgtgccccacctttgagtggt

SEQ ID NO: 1043 - DNA, 201 bp, Homo sapiens
catatgattctctacatacttaaaaagatttttgtctttgttgtctgcctcatgggaggagataagttgttataaaagttgtgcaaattttagcacaaaakacctagaaaccagcctcccattagacaaaaagccccaaacttggccttacatgactaatgtgttttattaattttgaatgataatcttgatgtcccacag

SEQ ID NO: 1044 - DNA, 201 bp, Homo sapiens
ggaatgtgtagaagccaaaactgatggaatagtaggatcatgtgatacatgtgcactaaagcaagctctcatcctagggagtttggctaaatcctggacamcttgagcttccaatttgatgactgcatgggtcaaggacagaggacagcacttgggtctagccaaagtggggattctaacataaaacttccacataaagct

SEQ ID NO: 1045 - DNA, 201 bp, Homo sapiens
ttagccttggagaggaatcaacttatttaatgctcttccatcagctctcagtcagtgcctgactcataattagcttttcttaaatatctgctgaataaatyagtgaatgaataaacccaagatcatatgacttataagttacagaactcaaaccaagcccagatctctctgacagcagaggtcacattcttcattatacac

SEQ ID NO: 1046 - DNA, 201 bp, Homo sapiens
actctgagaaaaaaaattctgttatttaagctacctagtcaggtgtattttgttatgacagtccaagctaatataggagttcattgtttgaaatagctgaygtttttccatcaaccctgactaatacaagttctttatatcattgataccatataatatttgttgatcctgtaatatgtagccaacattatgcaaaagaca

SEQ ID NO: 1047 - DNA, 201 bp, Homo sapiens
atcccagctgtaagcttcgtgcacagcatggagattgggaaatctctacaggctatcccatggttgccgcataaagagaaattttcatctagagttatgamtggaaacagaaaagctcaccaaaaccaaaaaccaaatggaaccacaagccatactttgcagaagtacagagccaaatattcactatccatgcaatattag

SEQ ID NO: 1048 - DNA, 201 bp, Homo sapiens
gtcattatatcaaaaagacacctgaatgtgtatgtttatcacaacacaattcacaattgcaaatatatggaaccaacttaagtgcccatccactgatgagyagattaagaaaatatggtgtagataaccatggattactactcagccacaaaaaaagaataaaataatgtcttttgcagcaacttgaatggaactggatgc

SEQ ID NO: 1049 - DNA, 201 bp, Homo sapiens
gtttataactttctccagaaactaacaagcaaggcagctcggcttgcaaggaagacaagatggctccatcacagagactgtaaaggggcaaaacaagggtkaaaactagctactcagagatgcaaaccaaaggcttttggcaaaagcatggactttattttcacaaaattctgggttttaaagtatttgctttttaccagc

SEQ ID NO: 1050 - DNA, 201 bp, Homo sapiens
atatttgttaaactatcaacgaaaaaactttaagaattcttagtaagagcttagtaagaactcagtgtgatattttttaaaactttttttgttcgtgtatyactattcactttttcaaggtatttagatatcagatcattcataaatcttattaaatcaatcatatctgcccctcagatagcaacttttagtcttctcagc

SEQ ID NO: 1051 - DNA, 201 bp, Homo sapiens
tttttcccggtagagaggtcattcagaagcaagaatctcaaccctgctcacttcataagactggaatctccccctcagactcaggctgatcgagggagatsatgggcctttagcatccagtgcttttctaaagcatctgcgttttttatggttgttgtggtttttttttttctgtttgtttgttcaccatcaatatttctt

SEQ ID NO: 1052 - DNA, 201 bp, Homo sapiens
cactaggttcctcccatgacacgcaggaattgtgggagttacaattcaagatgagatttgggtggggacacagccaaaccatatcacagggaaaggtggarttggtgcttatgaaggacctggtagtcagtagaggagtaaccttgagagagagtaatataacacgataacatctgcattagatggatcactcctgtagca

SEQ ID NO: 1053 - DNA, 201 bp, Homo sapiens
ttttatcatgatcatgttggatgtttattaattttattagtcttttcaaagaatcaacttctgacttttgtttttctctattaagtatctgtctttttatkttgttgatgttttcacctttaatttttcctcttctcttcttctagtatttaatttgctctctttttataacttgttgaagattaaatatgacttcaaagc

SEQ ID NO: 1054 - DNA, 201 bp, Homo sapiens
taaaattctgacacttggaacctcatctgagagtcatatgtttttgtcatgaggtgggaggaattactgggtgagtgacacgtggaagggataagcaggargcatgaattcttaagggcacttgtgaataatattattatgtctgaaagaaccacaagggagctgaaaattatagaatcacaaatttataaataatgagat

SEQ ID NO: 1055 - DNA, 201 bp, Homo sapiens
taacttttatcctacaaagtgatggctctcagtgtgtagcacttttttttttttaattaaagcaaggaaagtgctgatcatcttttgtgcttgtaagttgytatagtcaaatgaggagagtatgatagtctggctgttttaagctagagtaatgagaattccaaaaatgtctatagataaatttttcttgcagaataaggt

SEQ ID NO: 1056 - DNA, 201 bp, Homo sapiens
accatcaacccagcaagtgggagaaaaggtttgcaaactatgcgtctgacaaaagactaatatccagaatctacaaggaactcaaacaaatcagtgagaaraaaataatcccaccaaaaagtgggcaaatgacatacatagatttctcaaaagaagacataaaataggccaacaaatatatgaaaaaatgctcaacaccat

SEQ ID NO: 1057 - DNA, 201 bp, Homo sapiens
tttgctgacatgatccccacccagatttaattcaatcttgcctcattcccttgatgatctcctttttctccttggaaagcccttagaacctgaaaacttgyaatgcctctgaatgtgcagggcagtggcctagcatcctttgacccctttgtcataaaagccctgttgccctctgcaagagtcagtgcaaattttccccta

SEQ ID NO: 1058 - DNA, 201 bp, Homo sapiens
ctatggtatgggcatttagaaacaaaggtctggtagctcagcatggtcattgttactggagtttcattgctcctattattttttaagcccttgtagtgaayggaggtaggaaatacatgttttcttagtacagtataattttatgttgatattgccaattcaaattattattacagattttttaaacttattttgccttgt

SEQ ID NO: 1059 - DNA, 201 bp, Homo sapiens
tgattatcttctttcgttttcttctcttttcacaagcagattcataatgattggcttaatagtcattctggccttcatctgtaactaatgaaccttgtagmtattatgagtagcattctttcctgatatttgttaaactatcaacgaaaaaactttaagaattcttagtaagagcttagtaagaactcagtgtgatatttt

SEQ ID NO: 1060 - DNA, 201 bp, Homo sapiens
tttcattcgtgcattccaaaatatttattaactttactgaacgataatttgttacatattatactagatgttttaaatactaggataaataatatacaatycctgactccacggacctggaaatctcattagtgaaagacatggacatgtaaacaagttattttttacattacaaatcagaatgaggtaaatcaaatatat

SEQ ID NO: 1061 - DNA, 201 bp, Homo sapiens
gaatttgatctacttgatattaaaattacccaagatctgggatgattccaaaatgcttctctgaagcagttttaattcattttcttggcaaagatttttasgccatgtgaaaagtatctttcaggttttttttttttttaaaaaaaaaacatgccaagaaagttcatcaagacaaaaatcctatgtgggatatttttccaa

SEQ ID NO: 1062 - DNA, 201 bp, Homo sapiens
gatgaagtaaatgtaaacatgatacagactgaggccattggctctgaatatcgagacatcactggaatgttttgagaaattaactttgattgcgaagagaytaagaattagaatgcagtaggaaaatgaattaacatctgataagaaaagaaaccaaagagtaaagacctgtagttctgcaacacaggtgctcatcagaaa

SEQ ID NO: 1063 - DNA, 201 bp, Homo sapiens
cttcatacagcagagcaacatttgttttctgaaccacaggagaagaaattctaaaaataaaaacctgtctccagggacgcaaagtactggtaaagcaacayggcaacatgcataatgcaaaaaaaacaggtcaaatttagtgatggatgaacatcaaacgatttctagctctgtttcaatttagatacttattcaaagcat

SEQ ID NO: 1064 - DNA, 201 bp, Homo sapiens
tgctataaaaggtatagtttcctatttcattttctacttgttttttgtcaatatattaaaaactatttcttattggtattgtattcaccaactttgttaartttattacttctaatagtttataggtttcatttattcttttatagttttgataagatgtgattctcaagaaatgtgtccttttaaacaaagttgtcaaat

SEQ ID NO: 1065 - DNA, 201 bp, Homo sapiens
ctaaattcccccttgtaatgggaacaatagagtctgttcatcagactctatggtctcactctagtgtggtgttatgaaggcacagctaggaactacattgyccagccccctgttgcacttaggtgtgcccatgtgactaagctcttttatgtgcaagtgaaaggactggaatttatcttcccccagtcctcatgtccatct

SEQ ID NO: 1066 - DNA, 201 bp, Homo sapiens
gacattaaaatgtactgaacaattacatacacactttttctctggattggagagtttgttttgctttagaaagactgttgcaaatgtggtagctcatgcgycattttatttttttcaattcatgccctacaacaggagttggcaaactttttcagtaaaaattcaaggagtaattatttcagtctttgtaggccaaatggt

SEQ ID NO: 1067 - DNA, 201 bp, Homo sapiens
aaatgagttactctatgtaaagtacttagaatatatgtaggcatacagtacactctcaataaatctattatttttagctgcaatttgttaagtgcctattktatgccaagcacagcaataggtactggagaaataaagacaaataaaaaactatcaatgccttcaaagagtttgaggatgctaacagaggcaaacacatga

SEQ ID NO: 1068 - DNA, 201 bp, Homo sapiens
atttacagagagggcagtatattggtaaatgtttatcaaccagctctccagaaaagaaagaaaagaaaagaaagaaaagccctgaatttacagcatttgtyagtttctatggcataaatactccgagcatggtagatttcaaggtaccaatctcatgttactgaacacaaagttgggaagaactttgtgtacaaaactttt

SEQ ID NO: 1069 - DNA, 201 bp, Homo sapiens
tcagtgtttccttccagacatttttaaggtaattggctttaaaaagagaacatattttaacaaagtttgtggacactctaaaaaataaaattgctttgtaytagaaatagtgtcatagaatagtgtcatagtacagtttggaaaacacttctgaagtttcagatcacctaggaaatctagaaaaggagtttaatgtttttg

SEQ ID NO: 1070 - DNA, 201 bp, Homo sapiens
attttctgggagacttctcacttcatcacatccttccataccctctctggcagttctcttgaacttatcctagtgattcttcttcctattgaaaaataatrtgcgtactgccacaatttactgtagagttctgttgttagtgggataaggccaacaataccatgtagaattctgttgctcttccttcttcatgcatggaaa

SEQ ID NO: 1071 - DNA, 201 bp, Homo sapiens
aatatatttttcatctgttaaatgttgataatgacatccatcttccctatctacctcacaaagttataaaaaaaagtaatgtctaagaaaggcaagaaaaycatgtgagagtcaatacagtgtaatagaaaaatctctgtgtcaaggtgaagggaagcaggtaaggctgtccctcgtactcatggagaagggaaatgatgg

SEQ ID NO: 1072 - DNA, 201 bp, Homo sapiens
gcatggccacacaattgctgccttggttgtgaggaaccgtgcaagtcccacatcatgaccatcctgtcacgagaggcactgaagaactggctggatttggraatacaggctacctgctcagggaaaaaacaacaacactgaaatagctctggtatgctagttggactggactttaaattgggggaaagatgagtctgcata

SEQ ID NO: 1073 - DNA, 201 bp, Homo sapiens
tacagctgcggtcgcattgctaccagactagagtctattcatctccgtattcctggtgcacagtatggggcttggtatatagtaggggcttgttgaatgtytgttgaatgaatcaatggcagggatcctagccaacatttatttatttttaagacggagtcttgctctgtcgtccaggctgaagtgcagtcgcgcgatctc

SEQ ID NO: 1074 - DNA, 201 bp, Homo sapiens
agggctagatggtacctccaggccaggggtgtctcctgttcccatgcttcgggtcactgggcgagttctggtggtggggctagcagcctctggctcaggayggtcaacaggactggaagagtcccagctccgagttcgagagacaatgggaccagggctcttttcagcctgaaggaaaggggagataatggaagtacacga

SEQ ID NO: 1075 - DNA, 201 bp, Homo sapiens; identical to SEQ ID NO: 166

SEQ ID NO: 1076 - DNA, 201 bp, Homo sapiens
ttcataacatactcaaatttttaatgcttgctgcatttgtaatgttatccacttttttatttataataattatatgttgctttttacaaaaataaattccrtcagaatgttgtcagttttcttcttaaagaacttctggcttgattgaaccactttatgatatatatgttttctattttataactttctgattgttatcat

SEQ ID NO: 1077 - DNA, 201 bp, Homo sapiens
atgggccaaggaggggtcagcggcgaattctttcggcctgttggggacccctcgtgtccccacgccagactggacctcccgtatgaacttctcttcgcatyggcggcggcttccgtcacctccgctcccccgatcctattcccagtcgtgtaagccctgctttccttaacccttctccccctcagttccaggggtcacggg

SEQ ID NO: 1078 - DNA, 201 bp, Homo sapiens
ataatacataattataataaatatgatataatatatattccattgtataaaacatataatatatataacggaatattattcaaccttgaaatagaaggagrtcctgacatttatcacaagatgggtggacctggaggacattacgctaagtgaaataagccagacacaaaaagaaaaatattgcatgacgtcacttacatg

SEQ ID NO: 1079 - DNA, 201 bp, Homo sapiens
aatcccttggccgtaactggatatgtgaaggtacgcttgaaagaccacagcgctccagagggaggtatgtcaatcagatgatcatcaattatgtcaaaagrcctgctactagagaaggcacccctcctagaacacatcagagacatcataaggagaattcctttgaatgtaaggactgtgggaaggcctttagtcgtggct

SEQ ID NO: 1080 - DNA, 201 bp, Homo sapiens
tttccttcttgagctatgatatttgcgttctgtgcatctgcttgtgaattatctgaagccttttatctagtcaagctctttataattacctgtttcccagytctttctattccagtgaatgataatgccacgtagctccgtgtctgcctttttgggaaatcactgagcaggtgattaagtatctcctgtttgctccctttt

SEQ ID NO: 1081 - DNA, 201 bp, Homo sapiens
tttcatcttcaaaataggaaataataggactaattgtcgggacctttttcatgtctgactttaaaatagatgtctccaatgaattctcagttagtattgtrccagaagtagaatctacattttaacaagagccctgggtgattcacatttattctactggataatttttatttctattagacgagtttttggtttgtggtt

SEQ ID NO: 1082 - DNA, 201 bp, Homo sapiens; identical to SEQ ID NO: 169

SEQ ID NO: 1083 - DNA, 201 bp, Homo sapiens; identical to SEQ ID NO: 170

SEQ ID NO: 1084 - DNA, 201 bp, Homo sapiens
ctacctctcttgtgaatctggggccctactcttccagagtgaggggccctcttcatttgtagccagttggcagagtgtgattctggcaccgggcttggaaytgacatcacccataaccttacctaacatggggaccctgccgttcaccagtaagagatgtgccaggaactttacactcattattgaattctcacagcaact

SEQ ID NO: 1085 - DNA, 201 bp, Homo sapiens
tggccagagaatggcacttttgatttgtctatcctacaagacctagataatttttgtcaaaaattgggcaaatggtctgaggtgccttacgtccaggcctyttttacacttcgctctctccctagtctctgctcccaatgcagcttgtcccagattttccttctttctctcccgtttgctccttcagtctccatcccaagt

SEQ ID NO: 1086 - DNA, 201 bp, Homo sapiens
catacatttaatgttctggccttttagaaggctgcccacggactggtttattctcttgcctaacttgatgtactaatggaactggaatactctggatgccygggggccactgaaagcaagggagaacggggttgggaagtacatcttgctgcaacactggagggcctgtagtgccagagacagaggtcagcacactcagca

SEQ ID NO: 1087 - DNA, 201 bp, Homo sapiens; identical to SEQ ID NO: 171

SEQ ID NO: 1088 - DNA, 201 bp, Homo sapiens
aaaaaaaaaaaaaaaaaaaaagacatagtccttcctgcaaggaacgcagaggaagtgaaagtactctgaacaaggtgctgggggaacacaggtgggaatgrttaacttcacaggagaggggaatctgaaaggatgattgaatttggtctgaatgaataggtgtttatagcagagaaaagagaggaaagggaaagtttattt

SEQ ID NO: 1089 - DNA, 201 bp, Homo sapiens
aatagctgggcatcttgtgacccagttaagtggatacataagattaactatcacagtgactcagtggaattttttgtttgcttttgtacagttttaaaatraaagtttggtatttgtgttttggtatgctgttattttcattgtgaatgaggagttgtggggaaggtaagagattggtttccaaagagctttgagtccccc

SEQ ID NO: 1090 - DNA, 201 bp, Homo sapiens
gttttatacttggtttatctagctctgaaggcaatgctccttgttctttgcactgaaacattgtgcagatacgagaagcctgtagtttacgtatttcattrgccttttattattttaaaaaataaaacctgaaaaaaaagacctagtcctggatactttggtgatcttgttgtgtctggattgacgaacacgtgtcaggct

SEQ ID NO: 1091 - DNA, 201 bp, Homo sapiens
gtgacacctcagatcattggtctgccacttaggttttggtttcctcatcagcaaaatgcagataacttccccttacctgattgttttcagtgttaaaacasgcaaccttaaaaaaaaatctgtcacagtgcctggaactccttttccttattgccattttgtcttcattaatttgacatttactgtgggccactgagttgg

SEQ ID NO: 1092 - DNA, 201 bp, Homo sapiens
cacagagggacgttcatataaagaataacaactggctactagatagggctgttcttggagtcctcagttcccagtccattcagctggcctccatacagctsccttctgctcagagcccattctcttcaccaccattttaggaagaggccagtttttctctaccacccagaaacatctcacacatgcctcaattccacagtg

SEQ ID NO: 1093 - DNA, 201 bp, Homo sapiens
agcagctgtttggaatgttcctctctcagaatctaatcagctcaagaggagagacccaaagacgctgatattgcagttctcccagtgaggtggcctggcasgttgacttttagcaaatacttatactttgttttatttttctttcttctgtgctggccagaacctctatctactatattgaaaagaagaggtgctatcaaa

SEQ ID NO: 1094 - DNA, 201 bp, Homo sapiens
gccgaactacaagtctcagaggcctcagtttcattttttaattcctgggaatttaaccctcaattattctaaatggaagttgatgccggttgggtcggggsgacctgcaagcttgcgcacaaacgtgcacataagaacatacatgtaaggaacctgttcatgcagggcgtggagagagtgtgtcccacttatcacttaatt

SEQ ID NO: 1095 - DNA, 201 bp, Homo sapiens
agggaatgagaagcaaattggacagttctggcgaatactgaagaagagaactgatggtcactgacatatggacccctcactccacccctctttgctcgtcrtagcagctgtttggaatgttcctctctcagaatctaatcagctcaagaggagagacccaaagacgctgatattgcagttctcccagtgaggtggcctggc

SEQ ID NO: 1096 - DNA, 201 bp, Homo sapiens
tcgagtgagggaatagctgtagtaaaaacctttcccacattctttgcactcgtagggctttcctgcagtgtgggtcatactatgtcggaagaaaacagagyggtaggtgaaggtcttcccgcactcactgcacttgcagggcttctctccagtgtgaatcttcatgtgccgggttaaggaagagttgtagtaaaaggtttt

SEQ ID NO: 1097 - DNA, 201 bp, Homo sapiens
cctttctatgttcaaggcactcataaggtttctctccagtgtgactccttgtatgtcgagtgagggaatagctgtagtaaaaacctttcccacattctttrcactcgtagggctttcctgcagtgtgggtcatactatgtcggaagaaaacagagcggtaggtgaaggtcttcccgcactcactgcacttgcagggcttct

SEQ ID NO: 1098 - DNA, 201 bp, Homo sapiens
aaaaagaaaacccacaaattcccacatcatttgcactcaaaggttttttcctccagagtggatcttactctgttgggcaaaagcagagtggtagccaaagkcctttctatgttcaaggcactcataaggtttctctccagtgtgactccttgtatgtcgagtgagggaatagctgtagtaaaaacctttcccacattcttt

SEQ ID NO: 1099 - DNA, 201 bp, Homo sapiens
gcaatgaggtagacatgacctgggagaggctacttcagaaagtagcatctgaaggttaagaaggaagccatcacataaggacccaggacaaggctttcacrcctagggcacctaggggacaatgcagagctcccaggtcggaggggcctgtgctcaccagagggggactggctggggatccagcaggggaaaggtgctcag

SEQ ID NO: 1100 - DNA, 201 bp, Homo sapiens
atcaccaattctaagctgtatgaagagaaatcaccccagaataagaaatcccaaccaggaaatgataaaccattaacaaaagcagccctgaaaaatcaaargaaatataaagctaagaaagctacaaagcaggaagtaagaagtgacaagagtccagatttgacacctacccctgtcccccagagcacaccctgaaataca

SEQ ID NO: 1101 - DNA, 201 bp, Homo sapiens
actaacttcaggattccctcggaacttgattttttcattagtaaatttatcaccagttttcttttccttctgcttccccttttcctataaaaagcagtacytgtatgacagggcgtgggagggactcactgctgaaagcttacatgacaggcacgtgtgtgatgagtaggcccctgaaccctgctgggtgccaccaaccag

SEQ ID NO: 1102 - DNA, 201 bp, Homo sapiens
aggccttaaaattccattagtgaatttttaagccaggattcaggccttgctctattcaatgagtgtgtatatttgaggagcctcagaagagtctgaatacrcagtcaagtgttgtcattctcctcaaaagaggaattcgggcaatctctttgatggaacagtcaatgatggagctggacacacaattctggtgtgctgagc

SEQ ID NO: 1103 - DNA, 201 bp, Homo sapiens
catgggagggcaatactccctggacaggaagcacagtcttctattagggccacttgaatgacactgaacttgacactgagaacttgtctctgagaaatgaygcattttattttcccacagctggggccatgccagaggcattcatgctgcgctttctaaatacctcaaagacaggctggggctgcagccaagtcaggcaat

SEQ ID NO: 1104 - DNA, 201 bp, Homo sapiens
cacttggggaggggaggggagaagagaaaagaaggatgtttccacgcttgctcctgctgcgctccagctgagaaaccacacagcgtccatcctgctggackcctcgctttgcccatgacactcgctgtgggaatagggacccaggtagcatatttgtcattcacactttcttgaaatcagcatcatacaatcaccagcttc

SEQ ID NO: 1105 - DNA, 201 bp, Homo sapiens
attccataataaatacctctcatttcgttcacatcgatatacagtttactgagtcctttcacattagttcactcaaatcaatttcctgaggaaagcaccawgtgaggtttttgggggtgtaacagtgaacaagacttggaaggcccttgtcctcagggagcttacagcccactagggagacaggcatggccaatataagaa

SEQ ID NO: 1106 - DNA, 201 bp, Homo sapiens
gttgtctccaatcagaacctattaatggagaaattgacacggaaaggaaggaatcatttagtagaattggtaatgtgatgttgggtgaaatactttgatcyaagaaatgtccctgtccttgtttcctcactcactgtcccctcatagaaatcctcggtccccctatgtctcatgtcctgaaacgtcgggtgggagaggccc

SEQ ID NO: 1107 - DNA, 201 bp, Homo sapiens
gcccctcttcttaagtgcttccaacccagccagtccgagtaaagcaggtctgcaaacagggtgagcaggggtcagaagggaagagacagcctctataaacwtcaacaccatgccctagaactaggccccagctggagcctcgccagcagcctcccagtcaatcaagaaaaagatccggaattggggaaaaggaagatgcat

SEQ ID NO: 1108 - DNA, 201 bp, Homo sapiens
tactacactgacacttgatatgggtccagttaattctaaaactctgtgaagtaaatgggacagcatggttatcctttcctagcaaaggaataaaagaaaakacctgtaaggtgaaaggatttaccctctgttatacaggaatttattgtggtttgaatctttgcttgtctgaaaatatctgtattttcccaagcttgtaga

SEQ ID NO: 1109 - DNA, 201 bp, Homo sapiens
aacagagagtaagtcagagctggctgcctgacagataaaaaggaaatgaccaaaaaaaaaaaaaaagacacagaagaatactttgttgtccacacagaaamgggaagtgtaggtaagacagcagtagactaagattcttaagactcaagttctagtcttatttattagctatgggaggccttgagggagttctagaattaa

SEQ ID NO: 1110 - DNA, 201 bp, Homo sapiens
tgaatgcacaaattctagtcaaaagcaaagccatttgatgacatgtctgctatgttgccatttgctttaagagaggtaaaggtagcctgacttctgttcaytctgtagtacagaatacattgttaacaagtcataggtatgttcttttaggtttctaattactgtcagcctctcatttcagacaggtgatgtgataaggtg

SEQ ID NO: 1111 - DNA, 201 bp, Homo sapiens
aggaatctttccaccacttcgatttcatcttactcctgaaacagtcagccagaactgtctaattcagtctatacttctgatacaaaactctacccagcaaycactatggttttgttgctttaggtacgtgttagaaagcacccacatcaatttacagaaaatccttaactgaatctctagtcccagaggagtcatatttta

SEQ ID NO: 1112 - DNA, 201 bp, Homo sapiens
aaaaataaagggttctatccacacagttttggaattagtagatgagaaaatgcatatactattgtgactccttctgagattggacccaactaattatacayttttgtttagacagcatgcagcatagagatgaagaagagaaaccaatttttttttaaaagcaggaagaataagaattattccaaagcaagaataatcatt

SEQ ID NO: 1113 - DNA, 201 bp, Homo sapiens
ggggggataacttaaggtcactagaacccaaatgcagggaagagttgggtgctctttggcaaataaacattcctgacttagcatttttcttaaacccgaaygtgccagctgtttttttgtttttttgtttttttgttttgtgacctcagccaggcttgcgtgtttattcatcacatattctaagctcatatacaactgtga

SEQ ID NO: 1114 - DNA, 201 bp, Homo sapiens
tctaattttccagagcccctcatataaggaactgtattattggtataatcatcatggtgaagaagttggtatgtgggggagagatgacagaaacagagagwaagtcagagctggctgcctgacagataaaaaggaaatgaccaaaaaaaaaaaaaaagacacagaagaatactttgttgtccacacagaaaagggaagtgt

SEQ ID NO: 1115 - DNA, 201 bp, Homo sapiens
gagacatgataactaattgcaatgtgtgtttctgaactggacacttattttgacaatcaaatctgaaaattagagagtagtaatatctcaacatatcaatygcttaataaatacccagagcagagtaagcactcagtttaactatgatgatgacaatgatgacactgacaatgattactgaaggaccgcatgaaaaaatac

SEQ ID NO: 1116 - DNA, 201 bp, Homo sapiens
aggggcaatgatcagttctgctaaatgctgaattaaaccagaacctgtggcctgggcccaggagtggaaacatctgaggaatcagtcccacgtgggccaayagcaagatcaacgtgcttaataaaggcaactatccctttagttcccagaaaagggaggaaacacacccccacagcttgcttcctgcttcctggaggctaa

SEQ ID NO: 1117 - DNA, 201 bp, Homo sapiens
ttggcctcccaaagtgctaggatttcaggcgtgagccaccgtgcctggcctttactactttcttaacttcctcaagtattggtatgctcaggcataaaacygcagtcctaacagtcctgcacagcactgttgtgaagcccaatgagatgaggtggtttgcactaaactttatttctccttgagtcagttttattttgctgt

SEQ ID NO: 1118 - DNA, 201 bp, Homo sapiens
caaccccatttcatgtctgtaacactttccaacaccagcagggtctttgcacagaaaagaaaaaaatctgacgaataaaacaaggcctgaagtgtggcagrcatttgggttctttagagggtttaaagtaacttatttcttcctaaaaagtgacaagggggccgggcgcggtggctcacgcctgtaatgccaacactttgg

SEQ ID NO: 1119 - DNA, 201 bp, Homo sapiens
tagtatggtatacagagcccagtttccaaaacagccaaatctgccccaacacctggacgacgagtccctgtgactacaacacagccctgatgtttggaggygacccactccccaccctccttgcaatgggttcctcaaaaccagaacaagctaaaaacgaaccttacacaaccagcattttccagcacagtaaaccaaggc

SEQ ID NO: 1120 - DNA, 201 bp, Homo sapiens
ctaaaaaaaaaaaaaatttaaagtaatcatttttctcagcagttgaaaaacgcgacgtgaggtccaggcagcctcccctcagacagtgttatctcaggccractgtagcgagcgtcgaatgggaagacaggaacaggatcgctgcggaaagacttgcagatttactctgcagctacgcggtgcagaaataacaggacagac

SEQ ID NO: 1121 - DNA, 201 bp, Homo sapiens
ctcaattcaaattttagtttaaatatgtttctaatacttcccagagttaaaggaaaacagatataatatatagtgggtggtgttccaccaaaacgcttgcrtaatacaagaaaaacatcacacgcacacacaacccttacccaagaggtgtgttcaggcactcatgttttttttccctgagctgtagcagctccatattct

SEQ ID NO: 1122 - DNA, 201 bp, Homo sapiens
ataactgatttgtttatgtttttcaattatggataatcagatcttctgaagtaagaataataattttcaaaatatttttcatttgctgtttttgttcatcrtctgcttttttctaccatgctacatctgaaagccttggagagctaatgatatatttgcttcttttgttctcatatagatacttctctcctttagtcttaa

SEQ ID NO: 1123 - DNA, 201 bp, Homo sapiens
agaaacctcaaaaacaacccccaacgtaatgtccttaaagtataatattcatcactttgtttaaggaggagaagctggaagacacaagccaatgtttgctstgctctaacaggtctgtgtggatgtgtattttctctgcacttagatggtgaattccttgaggacacgagtcagaatttccaccaaatactccaagcaagg

SEQ ID NO: 1124 - DNA, 201 bp, Homo sapiens
atgtagcaacaaggcaccatcctggaggcagagtgcagccctctcgacaccaagcctgctgacgtctggattgtggacttcccagcccccagaactgtgarcaatgaacttctgttgtttataaatggctcagtctgaggtactttgttgcagcagcacaaatggatgcagacacagggcttctccccagcacattaccca

SEQ ID NO: 1125 - DNA, 201 bp, Homo sapiens
tcctgaggtcccgtctccagctgaccaaacaggaagctctggagtgtgaggcaagggcgtgcgacgtgtcagtcatgagctgtggacgttcccaggcgtgyaggcttctggtggctagggccattctcaggaggaggctgcagctgtgagctgctcctggccggtactcggagccaggagaagatcaggaagcccaggatg

SEQ ID NO: 1126 - DNA, 201 bp, Homo sapiens
ccgtcggcctccgtgaatcttaatgtgcctgaacagacccacagagacacagcatcagcttcacatttctcggtatccacttagtaatcattaagatcaaktccttgaaatacagatgataattcaccatctttcatcgcagcatgaggtttctgtttagggatttttgtccagttcatttgtttcagcttatcttcctca

SEQ ID NO: 1127 - DNA, 201 bp, Homo sapiens
acacatttctttaccttatgtgctcattttaggttcaaagccaagcatatgcagcaaaacatagtctacatttcaaaacttggaaaacttatgctccatcrtggaattaattggcacttttgtatttttcctaataagagaggccggaccacttccctcagaagggtttcctagttgtcctgggctgtttttacaaagttg

SEQ ID NO: 1128 - DNA, 201 bp, Homo sapiens
tctttagtcatgagtatagaagcaaggaggagagaggcttggggggaattggcaccccttgagaagcaactaccttaggagaggtatttaaaaatcaaggytcctatattgtcaggagcagacttaacttaatggacaaggaaattatttcatctggcaagagaggcttagtagttttaagggttttggatgccattggac

SEQ ID NO: 1129 - DNA, 201 bp, Homo sapiens
agaaggttacctcattccaggttactgcaggtgatcacgtaaggaacactttcgtcccatgtaagatgaactaccagtcctgtaatgataataggatcgtyactgctttcaaatccaactgaggaaaaaaaattagtccaagattcttacttctttgcgtgtctgttgacagcaaaatgtttggccttagttattctgtgg

SEQ ID NO: 1130 - DNA, 201 bp, Homo sapiens
gaatgtctgaaagcacatctcaataacgatgtatcaccactagttctggtgtagaacatctagataacaccttcatacttacccctgtttccaaacatgarggaagtttgggaacagcatattgtctctctgctctgcccattggagtagacaaccaggtaactgttagcacagaagcctcctttctcccttcgtcctgca

SEQ ID NO: 1131 - DNA, 201 bp, Homo sapiens
tactgtgtacatgtatgagagagagactgatccagactcccgggtcacaaatccctattagcactcgtgactttctttcgtctgcaaccactctgtagtcytttttttggtctttcacgaccttcatgtttttgaagaatatagactagttattgcatagaatgcccctcaatgtgagtttgcctgatgttgggctaattc

SEQ ID NO: 1132 - DNA, 201 bp, Homo sapiens
aagttagtaatacatgtaaatcccttagaacaatgcctggtaactattcaatacatatgaactattatttgctgttaccaaaagtgttcagagcagaaacygggttgtcaattctttgaattctaaggcctagcaccttgcctggctcatgggctggcatttagtaaaaggttgaggagctgaattaaaaattataattaa

SEQ ID NO: 1133 - DNA, 201 bp, Homo sapiens
ccctatcaaagaggatcttaagccatatcaaccacttcttaggattttctggtgacttctgagagaggaagagtcagaaacacccatgggcagtaacaccsagggctggctctggagtgggggtgaggtcattgaggggaaggccagggtttgggtgagcctgtgctgtagggatggaactctggttggcatagggtactg

SEQ ID NO: 1134 - DNA, 201 bp, Homo sapiens
ctggctgaggtagtcttgacaggtttttctactgtaaagtgattcttttttccaccttttcatactttactctttggaggggagtcactgtggatagccckcacttaaggagtgggagttgtactccacctccctgagggggagtagctacatacatgatggaattcttctgtctagagatttatctattctcccccactt

SEQ ID NO: 1135 - DNA, 201 bp, Homo sapiens
atcttccttctctgtcctctgctgaccccactgacaagcagtgactccaggtgcctccagttcaccccattggcagtgactccaggtgcacccacagatayttccctgaagctcacacagtgacaaccatgaggaggcaccagccttccatggacttccgcaccagtccccctttgggttcctctgcagcagctgcgtgtg

SEQ ID NO: 1136 - DNA, 201 bp, Homo sapiens
ttaacatcgtatgcctccgtccctttatacacctgcctcactttgtgtttcttcttctggttctcccagcagattcctattcactcaccagcagtcagctyatgttcattcctctggcaagcctttcccacctctccttactgaaccattctgggtgccgcctcgaatctcacatctgttgtagtctctgtatgatggtgc

SEQ ID NO: 1137 - DNA, 201 bp, Homo sapiens
tcttataagaagagtgagtcagaggagaaggtgatgtggccacagctgcctaggtgggagtgatgaatatggaggaagaggccacaagccaaagaatatakgtggccactagtagccgaaaaaggcaagcaaatggattctcctctggagcctccagaaggaactggccctgccaacaccttggcttgagcccagtgagac

SEQ ID NO: 1138 - DNA, 201 bp, Homo sapiens
aaaaaacacagttttaaaaagaatccaggaactggggacacagcagaactggatctcaatcctaattttttctcactttgtattaatgtactgcaaataaytgtagctagcacaagagagcacaatgactgtcttgctaaggtgagttgggaggatttatttcgggctctgttaatacatgttcgattgggagagttgggc

SEQ ID NO: 1139 - DNA, 201 bp, Homo sapiens
gtaatcttttttgaacagttattcaaatattgtgccagacagtgtgagggtggtggggcaaataatggaaagtgttcttgttcccctgggacctacatttygagggagaggtagataggcattttcataatcttcattttctttgcattctttatttgtgtttacctttctattgagtggactgttaaggaagcaccagag

SEQ ID NO: 1140 - DNA, 201 bp, Homo sapiens
ttctaagacttttcagtggaaaaaaggtagtacatgtattcaaagaattacgaatttgtaatgacaggtcagattcaaatgtaacagtacagctttttatsataaattctttgagtttatatttgtacctcttagactaaagatttccatttattttaatttattaagattgcagctgtttgagttaatctagtgtgaggt

SEQ ID NO: 1141 - DNA, 201 bp, Homo sapiens
gccttgtaggatggtgacccagggtttctgcacagggtctgcctccctgcttgtcacccctgggtcctctctctggctacactgctgtgttttccctggcyacttcctctccagggctgcctcacactgaggggtactttcctctgccttccccaaggatgcttctctgggcttcaagccacccagctttgaccttgcagt

SEQ ID NO: 1142 - DNA, 201 bp, Homo sapiens
tttagcattcaaaacagtcactgaacattagagcatgattaatatacccagagggataagggacaatattagtgatatgaaacaagttgagaagcaaaaargaacaaaatggaaatatgtatgagaaatttagaaataaatagtgtggtgaagtgattaatactcagaagaatacagctgaaagtaagcttgtgagttaga

SEQ ID NO: 1143 - DNA, 201 bp, Homo sapiens
gtttgtatgatatgggtgctagtatgggagagaaggaaaacgtgtgaggtttttgaccatttatgtcactctgtaagctcttctctggctactttggtgcyatagtagcagagttgagtagttacaacagagaccatgtgatctgcaaagcagaaaatatttactatctgggcttttacagaagtttgctgaccctttttc

SEQ ID NO: 1144 - DNA, 201 bp, Homo sapiens
cgtttgaatgcagaagcagataggagaatccagctgtcttctattaagccagacattaaagagatttgccaaaatgtaaaacagtgccacgttcttatttytgttttgttttggaaaacatagttatttttcataaaagtatgtttatttgtaatgagttcatggaattttaaaatgaagtaatattttataaatttttca

SEQ ID NO: 1145 - DNA, 201 bp, Homo sapiens
tggaagactgtgggcttagtttcttatggttactagtagttagtatgtgaatctagctcaaggttggagagatttttcaggatggctgtagttcagttgtygttgcttatgctagttctttcatttcattcaggggtatagaaactttagattgtctgaaaatgttattttcaggagttttcccattgggagacaaggaag

SEQ ID NO: 1146 - DNA, 201 bp, Homo sapiens
atattatatcagaattagttaggattctaaacatgctgaaaacttttcttctctaagcatgataaaaatattagtgaactctattttccatttgtagtctstaaggatattggtgatagtggaaagataatgacgtttttatgtgatgctagtgtattatttgaatgtacttcacatacacatatacgaagatagtctgga

SEQ ID NO: 1147 - DNA, 201 bp, Homo sapiens
tacaaacccttgtctcattttaatcctcataattctaatcctcacaaaatgtggaagtatccatattttatggatgaggagacagaggcccagagaggctrgacttgctcagggtcacacagttagtatgtggctgagttcatacttgaacatggatcttactctagaacttatactctgctcagcattcctcattctggc

SEQ ID NO: 1148 - DNA, 201 bp, Homo sapiens
agatcgttttcatgatttatgaaagacatttttaataagtcttatttttattacaacagtaatgtacagttcctctagaaatttaggaactatagtccccmaaaagtacacataaatgacactacctagagaaaattgttgggtataatttttctttccaaacttgaaaacttgtagagagagagtgtgtgtatgtacata

SEQ ID NO: 1149 - DNA, 201 bp, Homo sapiens
aaatttaccatcttaaccatttaccgtcttaatcatttttaagtgcagaggcagtggcatttagctctttcacattgtcgtgcagtcatcaccactgtccrtttccatgactcttttcatgttgcggaacggaaattttgtacccatgaaacaataactttctatttctctctcctccgtgtccctggcaaatacttttct

SEQ ID NO: 1150 - DNA, 201 bp, Homo sapiens
catgttgcggaacggaaattttgtacccatgaaacaataactttctatttctctctcctccgtgtccctggcaaatacttttctacttcctgtttctatgratttgactattctgggtactatatgtaaatgataccacacagtctgcgttcttgtgactggcttacttcacttagcacaatgtcattagaattcatccat

SEQ ID NO: 1151 - DNA, 201 bp, Homo sapiens
tggacttgctggatcatatggtaattctatttttaattttttgaggagctgccatactgttttccatagtggctgtaccattttacatttctaacagcagkgcacaagtgttccagtttctctgtaccctcaccaacacttgttattttctgtttttgtgacagtagtcatcttatagtgtgtgaagtgatatctcattgt

SEQ ID NO: 1152 - DNA, 201 bp, Homo sapiens
cacgcttggctaattttttatatttttagtagagatggggtttcaccgtgttagccaggatggtcttgatccactttctatttccttatagctcatgttgrcagcttttctctccaacatgggtctactcatctcatgtaaaattattactatacgttcttgttgagatcatgaaccttctctaaaaatttcatgaggttg

SEQ ID NO: 1153 - DNA, 201 bp, Homo sapiens
gtaacacatctaaaatagtaagaggcatgtctaaaattctagtgtaggtctgtttaacaccacagtgagtgctgcttttttttggtgattgagggcctacygtaatatatcattgtggcagcttctttggaagataagaaattatccaccagaaataaagaggacacattctcttttaaggaaaacaccatctcggctttt

SEQ ID NO: 1154 - DNA, 201 bp, Homo sapiens
gataaaatttgagtttgcaagtgaaaatcagaagtttggaaaatatgtattcgccaccatgagcttgacagcttttcagtatttaaaagctttatgagtawagtaatgatattaacaaatgtgatttttgatattgtataatgaaatgtatctacatttggaagatctgcataactcaaggaaccagtattttcacaaatg

SEQ ID NO: 1155 - DNA, 201 bp, Homo sapiens
gacttagttttgtcttggtgtcttgttgtttctactgatgttttcctgaaagatttgtgcctttgaatctgtgttctgaacttatactctggtttctcttygtatggtgttagtctttccccttttactaaagagctttgaactgggtagtttaaaagacccagattctagtttagtttggcttctagctcactttgttaa

SEQ ID NO: 1156 - DNA, 201 bp, Homo sapiens
tcctgcctcaacctcccaagtagctgggatcacatgtgtgtgtcaccatgcctggcttattttcatatttttattggagattgggttttaccatgttcgtmaagctgatctcaaactcctgacctcaggtgatccacctgccttggcctctcaaagtgctgggattatagacacgagccactgtgcccggcatattatatc

SEQ ID NO: 1157 - DNA, 201 bp, Homo sapiens
agcccaagttgacatattaaaaactctgtttgcttcctcagtttctaaaccacaaagatacttaatcttgcccattgggctgaatagatgaaataattacmctactaacatgagttgtaaaacttaccaaagataattcagataatgggtatgcttatgatttgataacaacttttaccttttgagtaatttcactctttc

SEQ ID NO: 1158 - DNA, 201 bp, Homo sapiens; identical to SEQ ID NO: 1157

SEQ ID NO: 1159 - DNA, 201 bp, Homo sapiens
aagatggcaacaacagacaatggggactcctagagcttgtggggaaggaggagggaaggaggaggctaaactaactattgggtactatgttcagaatccaytgtaccctaaacctcagtatcacacaatatacccaggcaacaaacctgcacatgtaccccctgagtctaaaataaaactggaataaataaaataaatatt

SEQ ID NO: 1160 - DNA, 201 bp, Homo sapiens
gtatctaaattacataaagaactctcaaaactcaatagtaaaataaacaaacagaaaatgggcaaatgatatgaacacgcatttcaccaaaaagcacagayggatgtcaaataagcacaaggaaggacatttaacatcatttgctattatgaaaataaaaattaaaattatgatgagctattactatacacatatgacaat

SEQ ID NO: 1161 - DNA, 201 bp, Homo sapiens
tggggagaggaagtagctgcataacacatatgataccctggaagcacttcccagccagagtctcaggaccacattacatccagatacaggtgccctctgarcacacttctctctctgcctcccactctgagctgcctcctggccccacatgggcagcctggcccaagggttggagcccagcaagtgttcagtccatggtgt

SEQ ID NO: 1162 - DNA, 201 bp, Homo sapiens
taacagatgccaaggagccatcagggactactgggcacacgtgtaaagggtccagacgccaacatgaagaggctctcattggccaaatatgggataatttsagctataaaataataactggaatgttttgaaacatatcaaatatttgaaaaactcaagactttataataatattaagaatgctcattaagcaggatgtgg

SEQ ID NO: 1163 - DNA, 201 bp, Homo sapiens
ctgacaaaaaaaaaaaaaaaaaactctgagaaaaataagaatagagagaaacttccttaatttgataaagaacttttacaaaaactccaacacttaacatyatacttaatggtcaaagaaagaatgtttttctcctaagaaagggaataaagcaaagatatctgctcttactactctaattcaatatcgcactggaagttt

SEQ ID NO: 1164 - DNA, 201 bp, Homo sapiens
cctgggaacagaagccaaggttacttttattttgctgtagcaaagaacatggctgcatggtgaccctgccctggagatctgtgaaactttaaacttgaggktgatgatgcagtgcatatctggtggaatgaacttctaggaagcaaagctcaagaggtgtcctgtctgcattgaacagcctgtgctctgatgtgtgactga

SEQ ID NO: 1165 - DNA, 201 bp, Homo sapiens
gtagggatgcagagggcaaagtgttcccagagggctggtggcagggagaggaaggggcagggtgctgagctgtatttaaaggggagaatttgggaaagcayaagcaagcggtcatagcggccccttcactgattgacggagcaccttggccccttcactgatggagcacctgtgttccagctctgctagctttccaggcaa

SEQ ID NO: 1166 - DNA, 201 bp, Homo sapiens
cgacaagccctgcttcagttacacccggaagctgactggtccacgcatggccgaagcatgaggaaactcatcgcgggactcattttccttaaaatttggamttatacagtaaggacttcaactgaccttcctcagacgaaggactgttcccagtatatacatcaagtcactgaggtaggacaaaagatagctacagtccta

SEQ ID NO: 1167 - DNA, 201 bp, Homo sapiens
ggattatatgacataggaactattattatctcactttacagataagggaacagagatacaagaaggtggtagacttgcctagaatcatacagaatttctgrgctttgaaacaagtcactagaaggaaggaaaattctttaaagagtaatccatcagtccattcagcatccttgttaggtatcttgtacaatatccagaaaa

SEQ ID NO: 1168 - DNA, 201 bp, Homo sapiens
ttgatgtaaagtggatgaaaactgctgtttagaatacaccaggaaaagcgacaccagccagatcttattctgaaagacttaaaacatacccgcaaaatcgygggcgggggaacccatatttatcatatttataatttgtaatatgtaaaagttgatgctaacccaaaattattattctgggattctttactggaaaacaca

SEQ ID NO: 1169 - DNA, 201 bp, Homo sapiens
atcttgtctttaaaaaaaaaaaaaaaaaaaaaaaaaaagaagaagagtgactattgtgtgaactttcagagtccccagtcttcagagaaaaaaaactggaygtgtgcaaagaaatgataatcagaaaaatattaaacttcttgataaaattttcaatgttacaagtcaatgaaaaaatgtcttcaaaattctgtagggaaa

SEQ ID NO: 1170 - DNA, 201 bp, Homo sapiens
aaagcataggatgatgggtcttgtccagttcaactcagggaaatgcagagaaaatcccaccttaccactttgaggaagcagagcatcagtttgtctgagcrcattagggaagagagcagaaggcaattgaccttgattcagtccttaccatttgaccttaattcagtccttactatgtgccaggcatgaaagtacatttct

SEQ ID NO: 1171 - DNA, 201 bp, Homo sapiens
tcgacaacctcacacacagacttccaattaggctgttagagcctctcttccaaatgtgcatggttagggatggcccaacactgctggagcatccccagtgygagactgcccaaccaaacatcaaagacatgaacagaggaaggaaacaaacctggaaaaaactaagacgatgatggaaagagaaaaaactaaaaaacttat

SEQ ID NO: 1172 - DNA, 201 bp, Homo sapiens
gagtgggtctcatttttctcacttctcattcctgccgacctgtggcaggtgccgttcagatgctgggggaaggaaaggaacagctcagcaatggtgacagratgggcgccgccaggaacagtcgcacagcagatgctccgtgggggcagcggctcccgttatgcagccctagagcgggcaggggcaccaggcagggcaggg

SEQ ID NO: 1173 - DNA, 201 bp, Homo sapiens
cagatcaggaggaaatgaggtaggccctttagcaatacagggtttagggtgacccactccccatgcagccgaaaatccacgtataaccttggactcccccwaaacttaagcactgagaaacaaaagtggctcagaggagtcggcgccacgcgaggtattcaccagccccagcggagctgcgagggtgagacctgcatcatg

SEQ ID NO: 1174 - DNA, 201 bp, Homo sapiens
agcgtggatgtgttgaaactactaactttaactcatttatacagcgagaatctaataacaaacaagacctggtttctgcctgcattgtgctcattttcagycctttcctagattaggctcagccagcgtcctccccggaatactctacctgcagctcacttaactccagcagctatggctaagtactgagctgtggtgcac

SEQ ID NO: 1175 - DNA, 201 bp, Homo sapiens
actttaactcatttatacagcgagaatctaataacaaacaagacctggtttctgcctgcattgtgctcattttcagccctttcctagattaggctcagccrgcgtcctccccggaatactctacctgcagctcacttaactccagcagctatggctaagtactgagctgtggtgcacgaagtcttgggccaagaatcaaag

SEQ ID NO: 1176 - DNA, 201 bp, Homo sapiens
cccttcccagagtgctggcctcacctccacagagacccagggctccctccgcctgtgccccacagaggcagctgggacggaaggggccccagcctgcaccytgggccagcagccgcccctgcgagccgagctgggctggaaacgctctgctgggcctcagctgtcagctcctgtccccggcctggggaacgagctgctggc

SEQ ID NO: 1177 - DNA, 201 bp, Homo sapiens; identical to SEQ ID NO: 635

SEQ ID NO: 1178 - DNA, 201 bp, Homo sapiens
cccaaagctcctgggagatgtggctaaatgtagctactttggtgtatcagtcagcactgctgagtaacaaactactccagtcattgtatttgttctcgatyctgcaaagcttggtctgggctcagctggacggctcttctgttgggctctcctggggtcgctcaagcagctgcagtcagctgagacttgactgggcttagc

SEQ ID NO: 1179 - DNA, 201 bp, Homo sapiens
gtcccagggtttctggggtgattaggtaagattgtgcctggcctggtgaacactccattggtccatggcaggtgttctgcgccctaccttgaagattactrgtccccagggtaggtcagtgcccctaagcttagggggcttgttgagcatgttctgtggttctgtgtgcaaggcctgaaccatgacagctctggcccagcg

SEQ ID NO: 1180 - DNA, 201 bp, Homo sapiens
agtatggagggggctcccggacattctgtcctccctgtgccccaggtcgcatcagtgagggaagttctccctccagctgaccggggtccgtgcagccaccrgagtgcacaaccacagcctctgtctctcctttgtggagtttgaggatcctatctccctccggcctccctcactcccctctcttctccctctatggctggg

SEQ ID NO: 1181 - DNA, 201 bp, Homo sapiens
agactggaaggctggacagagtgctccttggggtcttaagtagagccaaggagggcatttgagggcagaatggccttttccctgggggcctgactccccamttaccaactcccaaggggttacagactggagggccctggcagcagaggctgctgggtaacagcccagcagagctgctcattggctgccacccttggactt

SEQ ID NO: 1182 - DNA, 201 bp, Homo sapiens
ccaggcaggggaggaaatggtagtagggggtctgactcatccccatgtccccagcacccagtgcagggcaggggtggggggtgggcaggaagtgctctccrggtcaatggtgacaacaatgggtatgtgaacagaggcggcgggggtgggggacgcaccccagaaagcacctctctggagggcctggggtcagtgcagggg

SEQ ID NO: 1183 - DNA, 201 bp, Homo sapiens
catgtgtgaacctatcagggctacagggcagggaaccaaggcccaagtttcaagccccagattcctgtggagtcctgtggaggagagaagcaggtcttccrgtgcctcagtttctctccctctgtgacttgggaggcaggaacccttgttcacacctgctggctgagcagcccaggcaggggcacccctaagcctcagtca

SEQ ID NO: 1184 - DNA, 201 bp, Homo sapiens
ctcaaagtgctgagattactttggaagtgcaagaaccaccgcgtctggcccatactaaatattaaggacaattgtttaaagacatggattgtcataaaatrgtataacacttgttagatctctaagccaacaaaccaactggactcttttttaagaacgtctcaaacacccgggcttctggttctttcatgcgttacctta

SEQ ID NO: 1185 - DNA, 201 bp, Homo sapiens
cataaataatgttttttctttcttcccccactgttgatagctgcaaaacaattagcatcagccttgaccagctgcacgtactagattttaaaatgtgtgcwttttcattttggagaagatgtaatggaccaacattaatcattgtttttttctttacccaacctggcacatagaagtaagaggaagagaatgaacaagaaa

SEQ ID NO: 1186 - DNA, 201 bp, Homo sapiens
gatacttgtacaccaatgttcatagcagcattattcactatagccaaaaggtggaaacaccccaaatggccatcaacagatgaatggataagcgaaatgtrgtatatccataagacagaacatcattcagtttaaaaaggaatggaattctgttatatgccatggatgaaccttgaaaacattatgctaagtgcaataacc

SEQ ID NO: 1187 - DNA, 201 bp, Homo sapiens
atatcaataaaagcaaacacacaaaagaataaaaatagattgagaaacaaacagaaaaaaatacctagagagatctctgcttgctgcctcatccctcagcmttctcaagtgcagtggtacgatcttggcttactgcaacctccacctccaggactcaagtgatcctcccacctcaacctccctagtagctaggattacagg

SEQ ID NO: 1188 - DNA, 201 bp, Homo sapiens
attgagcttcactatgaaccagactgtgattgtggtcataaatttcttttctctggaaggctgcctctcaaatgttcatcagttagcaagtaaagctagtyagttctagatcttactcattcaacctgaaaataatattctagaaagataaaataactttatgtatacataataattaccatgtaagcctgttttaaaatc

SEQ ID NO: 1189 - DNA, 201 bp, Homo sapiens
aatgtaatttcatatgtgacaccatttaccgtatgttataatttgacaagcttagtgagaacttggttcatgaaaagcaaacattcataactttctttctyggaagcctcattacaaaattacatataatataggcattagatttagaatttaaataagagaggaatttaatatcaactaaaacaagcataaaagaacatt

SEQ ID NO: 1190 - DNA, 201 bp, Homo sapiens
aagagttctgcacttgtctaacttaatcagaagcctcccagggcagaaacaggtagagaaggatcaggggtgtgtggtgtagatctaggcagtcaaatatragatatgcagcccaggaagaactttaacatctctcctcccttctcttttcttctctcccttctccttatgtctcatatgtgtgcgtgcacacacacacac

SEQ ID NO: 1191 - DNA, 201 bp, Homo sapiens
tggaaaagatgctttaaaatggtatgtgggagtgggtgggtagcccagagcttcctgccctctccagacatgccaccctgtcagcaaactgttgtgttcamcaacctgaaacctccccaacctcattgttcaagtttttactgagacacttcattacttggacactgtattagtagtccattcttgcactactataaagat

SEQ ID NO: 1192 - DNA, 201 bp, Homo sapiens
ttatgaattttcgtatgctttacctacagatcactggttattagaaccaagcaaccatgggtctgcactttgtttgatttgccagtttcaacatttatttmatttgatcacaaaatagtgctaatcaaattctccaaacaagttttgtgagaatgtaaaaacaaaaagaaaacaataataataaaagccattactgattat

SEQ ID NO: 1193 - DNA, 201 bp, Homo sapiens
cattccttttgttttattttcaagtgctaacatttgcctatccctaaatagtttttgtttgtttgtttagttgggagaatttgggtatacaatttatatcrgtatttttgttgttattgttgctatttgggtgctttgtgtatggtattagattcctttgttttaagagtatatacctcttctgatattatctgtttagta

SEQ ID NO: 1194 - DNA, 201 bp, Homo sapiens
tttattttgacatccagatagcatttgctgaaatgtgaatggtgtgttctctgctacttaattttctaaggtcatccctccagctttctaaaatttgtcayttattcatctgtctttaagcttgcaattggaaatttgggaacaaagtggaattgtacaagcagcaggactgaaaatacaaatattcttcctcttgttcct

SEQ ID NO: 1195 - DNA, 201 bp, Homo sapiens
aaattctgtttgcttttattttatgtttgtaaagatcatctcaaatgacctttataaatatcagaactatcactagaggatgtcattaggtaaatgtctcytctgacaatagtagtatgagagccttcgtaaggactaatacctatggtaatttttcttagaaatgattttagatgaaatgaatcaaaaagggccctagca

SEQ ID NO: 1196 - DNA, 201 bp, Homo sapiens
ttgcaagaagaaataggcagacaccagaaccctgatatgtgacatttgtacatataaatttagtgaaagacagttgcagtttctcctgtcataatagccawtgggttaaacactgacatacacacacactgtacacaacctttgtacctgttggcatcacataagaagtcggtctacttctagtctaccttctcaagtaca

SEQ ID NO: 1197 - DNA, 201 bp, Homo sapiens
cctctcctgctctgatcatgtctaactagctacctactctaacactctaacactaaggattcacagatttttaaatcactatctcatatggaactcaccgyaagcctagaaaggtatttgagtagctttttacttgtcttctataatgtaccctagttattttatgaattttcgtatgctttacctacagatcactggtta

SEQ ID NO: 1198 - DNA, 201 bp, Homo sapiens
tttaactcaattctgatatattatctagagttagtgcagtcccacaaattaggagtcagttgcacaagaccatccccaattccattgtcagccaaagttayggtatcctcaagttacccatacttgacctggctgacccaaaatgtgggggttccctcaagcctttcctctcctccccctccaggttggaaaatgtgttag

SEQ ID NO: 1199 - DNA, 201 bp, Homo sapiens
ttgactctttcttgacttaagaattaattattgaaatgtatcagatgcactctgaaaatgtcagtgtatttagttggatttacaaaaaagcacagcttttyagccaacatgatattggaagtgaatatcaagtagcacctttctccacacatccttttcacaggcaacagaaaaacataaggcagatgatctataccatct

SEQ ID NO: 1200 - DNA, 201 bp, Homo sapiens
ccagtaaaaaaaagaattcactacctcccttgtattgggtagaatattctacaaacctgtcctcacaaatccagatacaggaattcatacactgaatagcrcaaagaggcagctttcaagtgaaaacaatttaaactcaaaggttaaaatcacctcaaaagagattctaaagtatttattaaaacatctcaggtatagatt

SEQ ID NO: 1201 - DNA, 201 bp, Homo sapiens
aatcatttttgaaaaacataatatgaaaatatatgaccataaaatcttgatagctctctagcagtgcttgtagaaattgcagtctcttttcaaatgttatrgtaggtggcaactcagtagaaaattataatagctgtcaaaattcgtatacattttataaaatatgcattttgttactttttcaggtgcttgtagtaatgt

SEQ ID NO: 1202 - DNA, 201 bp, Homo sapiens
attacccattcgacacatacacccacatacacacatcacacacttacatacattttctagtaacagacaagcctgcacattaatacaaatcttcaggaaaycccacttggggcacatctttgaaatctcttgctttaaaaatagagagctttgtccttttgggtgaaacactccccaaatctaggggaattctggctgttt

SEQ ID NO: 1203 - DNA, 201 bp, Homo sapiens
cacacagtttagctagcagcaattaatatgagtagcactatcaaaattctcatgaaaacaaaaagtaaaaatgaaaaaaaaaaaaaacaaaaaaaccccaygagaaacaattttcaaatactcacaggtacatccacatatttggaagctgccttcacctaaagaggaaagaagaggatggaagtgaggctggtgtttatg

SEQ ID NO: 1204 - DNA, 201 bp, Homo sapiens
caaaattgtacatgttaaactggtgaattttatgggtatgtgaattatatctcaattttaaaaacagtagctccaaggggagaaaaattaaggaggaacakgattctggaaaatatgaactcaaagggatctcaatgaacttttgagatcaccaaaaacagggcctttaaagtgggcttgatgaagcctaagagattgttt

SEQ ID NO: 1205 - DNA, 201 bp, Homo sapiens
tcaatttaaatgtaaattttgggaaacttcgagtgctttatctgtgaactttgagagctctcttcattaatgaggcctgcactaaattataagcagttttrtgaggtttccttaaaacaattgcagaattgaccccaaaatgaacaaatttagaatttatttgttttttttattaggttggtgcaaagaaattatgttttc

SEQ ID NO: 1206 - DNA, 201 bp, Homo sapiens
agctaagcagttttaccaactaacatagtatgaatatttcaactgtaagaatgtcatttcacttctttgtgttgcatacttcttatcttattttgactcargaagtctcttcttctggaagagactgtccagataacaaagcagatcttttactacacaggaatatgcagcagcatctccgatcattgtactttcatgttt

SEQ ID NO: 1207 - DNA, 201 bp, Homo sapiens
cccatttgcttttaaactattagtaactctccatgacactgagtttgctgctgagtttcctgacatagcatcatcagagataatatttggttttaaacackgaacaaaattagaaagctgctcaagaggtcaacactagggtgtcaacacattgccttggagaaagaaaacaatgaactctggaagctttttaaaaagaag

SEQ ID NO: 1208 - DNA, 201 bp, Homo sapiens
ataatccactcagaattagcccagtccgtttgaaactctctcaatcatttgtgtctttgcctgcaacattatcttgtagaatcatctttcttttctaaatyttctagagtctagttagaagactatacattacaggtgttcataaaatatttgttgcactaaattgaaaagtgaaaataccactgtttcggatgtgaaaaa

SEQ ID NO: 1209 - DNA, 201 bp, Homo sapiens
aagaatggatacactcatacataagtatatgcatgtgtttatacatatatgcacacatatttaagttataagaagaagctcctgatatagtttgtcttacmtttagctaatctcgtccatattttatattttgtgtttatttataactaatgataaaagtaatacttgcttatgtaaaatttgggaagaataaaaaagcag

SEQ ID NO: 1210 - DNA, 201 bp, Homo sapiens
atttagttacataattacttttcatttatataaagtaatataacacagctcctacagaagtccaaaacatttcttgcccttgctcatttgattgatgaatrtcaataatacattcaacagcaaaacatagtgacagaagtggtatcagggcatgattttgtaataaggatcctgccagtgacacattttagcttaattcag

SEQ ID NO: 1211 - DNA, 201 bp, Homo sapiens
tacttaaaacatgtttaataagtacaaaatatgtctcaactcagaattaatgtagaaacctcataattaattcattaatctattaagtgcctattatatgrtactatggaggccaaaagtagtgaactaaaatactttaattgtttaaaattcataatgagttaaaagaacaccgtcatcttcacaaacactttaaaaaaa

SEQ ID NO: 1212 - DNA, 201 bp, Homo sapiens
tacttacactatcttaggtaaataagacttttattcctaagtgtgaattttcacaggaggagaaatctggcagatagatcctcaccatcatctgaacactygaactggacttccttttctgaattgaccagtcaaagagaaaggaaaagaaaaaaaaatatgaccggttgaatttagagtatcaaagcatggagtatagaa

SEQ ID NO: 1213 - DNA, 201 bp, Homo sapiens
tcctagctcattatcctggaggaaggcagtcattcctctgacctctcctgtttgcttttttcttgctatgtttccttaagcctaggaaacctgagaagaasagtaagacaggtgacactttgccaggtgtaccctgagacttattttttcccttatccaaggtggtctcttggtctctgtacctaggagatctatccctgc

SEQ ID NO: 1214 - DNA, 201 bp, Homo sapiens
ctattttaaagtattttttaggtaaggtatgtgcatttagacataatgctatcgtatacttaatagactatagtacactgtaaacataacttctatatgtrctgggaaaccaaacaatttgtgtgactcactttattttgatatttgttctattgtgagaccagaaattaaacccataatatctctgaggtttgcctgtat

SEQ ID NO: 1215 - DNA, 201 bp, Homo sapiens
tagaaaataggaaggaaactaggaaaacaaggagagataaacacaaaggcagaagaggctggaaaaggcctttgatgaagcaggcaaagaaagagtatgamatgtcccttatgctgagtcctgcttcccttggttactgactattgtatgccacactatccctctagtgttcaaggtccaaatgcagcgttttagctacaa

SEQ ID NO: 1216 - DNA, 201 bp, Homo sapiens
atgcagcatgcagtaattccaactacagagaccacagctatcagtacaatgttcaacaacgaaatgagataatctcatgttagaacacactgcttgacaamtaacttaaccaaaaaaaaccaaaagaaatgaacttggtcatatcatagaaagcaaaaaaaaaaaaaaacaaaacccaacacccaacgaaataaaatattt

SEQ ID NO: 1217 - DNA, 201 bp, Homo sapiens
atcatacctttcacatcttcatcctcaattgttgtatttgaactctcagttgactcctgatgagaagaaaacacatttttaggttgcacgcaatgaatagyttgatttcctccttaaaaattggctagtgacatacatatcatgcaaaattcttcagcaggctatgtgcatatgctgacatgcaaatggacaaacacatta

SEQ ID NO: 1218 - DNA, 201 bp, Homo sapiens
agtgatgttgtaaaccatcccatatactcagaggacaaaaacaacacatgaaaatatgagaaagaaactagaaatatgaaagaatgataaaagagctacamaagtgaaaatggaaaataaatgctaaaaaaaggaaaacaatattagaaataaactaagcttaaactttttaagggaaaatttaaaatgttgatgtcttac

SEQ ID NO: 1219 - DNA, 201 bp, Homo sapiens
tagaagcttgctttgcttttctttttctggtttcatcaggtgaagtttaggttactgatttgagaattttatttttggatataggtgtttaaagctataartctttctctaagcactgcttttagctgcattccataaatcttgatatgccatatttttgtttccattcagcttaaaatattttctaatttcccttgtaat

SEQ ID NO: 1220 - DNA, 201 bp, Homo sapiens
caaaaacattatccatgccttgtcccagggcagttcaatatttcaaagtaactggaaaatattctcacttacattcatcactatgcacaaatagatcaaayttcaagcaggcaaattttctatttatcaaatataaatgtaatatttatcatgtgacagaagcttttctgctcattatagatgatttctaagtgatatgaa

SEQ ID NO: 1221 - DNA, 201 bp, Homo sapiens
gcacacatattgcaagcatatatgacatgtataacactgcatattgcatgcatgtgtattgtatgcatattacacgcatacaggaatatcacataaatgtrtattgcatgcatacactacacgaatgcttattacatgtaaatcacatagatgcatattacatgcatgcgcatcacatgtatattacctgcatacatatta

SEQ ID NO: 1222 - DNA, 201 bp, Homo sapiens; identical to SEQ ID NO: 1174

SEQ ID NO: 1223 - DNA, 201 bp, Homo sapiens; identical to SEQ ID NO: 1175

SEQ ID NO: 1224 - DNA, 201 bp, Homo sapiens
tgattctattatccttgttattccttctccatggggctgttgtcaggattaagtgagatagagcacaggaaagggctctggaaacgcctgtaggctctaaycctgaggcatgggcctgtggccaggagctctcccattgaccacctccgctgcctctgctcgcatcccgcaggctcacctgtttctccggcgtggaagaag

SEQ ID NO: 1225 - DNA, 201 bp, Homo sapiens
gactcccagacctacagccctctttccatggcctccaggtgactctccagtcaccatgggagagccggaattgggaatccagccctagtattaactgtctrgtcttagcccagaggttctaaaagttgactttactccggccgtatgcaattttgcacttaattacagtctgtttctgttccctattctttgtgtattccc

SEQ ID NO: 1226 - DNA, 201 bp, Homo sapiens
ttccaaatacgtccaggctgtaaacttcaggtatcaaccatgacattgtgggtctgctcagcccacttcctcctgggagatctgccctagttccccgctcsctctcaggacattatctgtagggctgggaagtgcagagtccatctggggttgcttggtttacaaggttttagggtccttttcaggagaggtaggcagagg

SEQ ID NO: 1227 - DNA, 201 bp, Homo sapiens
agagaggacagcccaggcccccatccttgcctgttccacggctgtggctggtttgatggggttgatggccaatgctcacatatttacttagggcctcatcrgccacaacccagaaagaagcagcaaagtgcccacccggccactcacatcctctcaccccacaacccagggggccctcagtcacgctgggcagcgtagggc

SEQ ID NO: 1228 - DNA, 201 bp, Homo sapiens; identical to SEQ ID NO: 1227

SEQ ID NO: 1229 - DNA, 201 bp, Homo sapiens
caacatattctattctgcagagtagcaggtaataaataaggtattagggtagcttttcagttcaaatttaattttgattcctgcagtggattcgactgtgrcattcaaacatagatttgcaggtgcagagagagagtgttacttagccctgcagtgtgactaattgctggtaattgtctataggaagggcgttagaaaggc

SEQ ID NO: 1230 - DNA, 201 bp, Homo sapiens
atcacacgctccatttattcattatagaaagctcagatgcacaaacatgtggtgccattttgtgtacctgtcagtttagtgcgtttaatgaacattgatcrtgctcatccagacacacttctcgatgctgcaagcaggaagtcagtggtttctgaaagacagggtgaaaacttgttttttttttttttttcaaatgtgcct

SEQ ID NO: 1231 - DNA, 201 bp, Homo sapiens
gccagctactaagcggtagatccagggctcccacccacgtggtctgattctagaacctgagctcttaaccgctgtaccgacttgtatcactagccaacatytgggctgctctctgctttatcaatgagtaaactgaagcccaggctcttaagtgacttgtcaagttaacagactattcagcaacagatttgaattttcgta

SEQ ID NO: 1232 - DNA, 201 bp, Homo sapiens
ggtgttgacatagatgaagatgatggttttccctatcttaagtgaaaaacaattcatgtttcgctttgggtagactgaatggcctttaaggattacagttraagatagttttatccaaaaggtctcaacgcaaatcttttcttatagattagtctattaaatgtgaggggcatctctaccagagattctggcagggatggc

SEQ ID NO: 1233 - DNA, 201 bp, Homo sapiens
agtagaaatgagattttgaccacctcaggattcacttagaagcgtgttggaaagattcctgctcagaccaaacatctcccaccttccattttcagagtaaygtgttccgtctgtggaaccacagcttcatttgcatggaagtgatagggagccattctctacagcattgcaaactatggagactgtatacaagtctcagtt

SEQ ID NO: 1234 - DNA, 201 bp, Homo sapiens
tcagtgtttctttttttcccatttacttagttaagcagtcagttttaactttactatccagctgattttgtgtataaatggattcatttgtagtttatctygtttttgctaggctgtgggctaggaaggaccaaatggatttacgtagtttatcggataaaccaattttgagtatcattttgtcaggaaaccctttttaac

SEQ ID NO: 1235 - DNA, 201 bp, Homo sapiens
atgttagtattttctcttaggtgttttttaagcttttaattattttattgaatctttctggaatcactctcttttggcctttggtgttgtggatgtggaamtagggtgttagaaaggaatcctttgtgattttaatgtttggttgggatgttaactgcaaattatgccatcaactctgacagctattttatatatattcat

SEQ ID NO: 1236 - DNA, 201 bp, Homo sapiens
ctcctaaaatgatgggatgggatagaaagaatgatgataacccgattaatctccctttagggggactctggagtcaggagatgtgtttgtggccttggtarcagccttcctgctggttagaggaggacctgcatattcttgggattcctctctcataatgggtcacaccacatccaggtattaccacctgggagaagaaag

SEQ ID NO: 1237 - DNA, 201 bp, Homo sapiens
gctgccaccttgcagttccatctcagactgctgtgctaacaataagtgaggctccgtgggcatgggaccctccaagccacgcgcgggatataattttgctraaaccattggaaaagtgcagtattaggatgggagtcacccaattttccaggtgccatctgtcacggcttcccttggtgaggaaagggaattcccggaccc

SEQ ID NO: 1238 - DNA, 201 bp, Homo sapiens
aaagtgatgcattagactgaattttgtctaattgtgtgtaattgactttttttaaagaagaaattccgtggaatagataagaggaaccataattaatccartcaactcagagggactgaacacgtgttatgtgtcagtcactatgcttgccgctgaggacacagtagagagcaaagaaacatgctggccctgacctcaggg

SEQ ID NO: 1239 - DNA, 201 bp, Homo sapiens
gtgcttgtttcctactccattagtgatcttacctctcctctaggatacctttcatattaatttgatactcagtaagtatttcatgattgaacggctgaatrcctgaatgtgtgaatatttttaaaaactttttcgatcacatttatcctggagtgagatgaaaatatagctgttgcatttaagaatgtaagtagtgggtga

SEQ ID NO: 1240 - DNA, 201 bp, Homo sapiens
atcaaactagaacaattgcaaattaacaggtttttaataagtaaataatgccatctagtttatgttttgggtaaattttaatagaagtttgaaaaggattyattaaggtatataataagttatttgagtttgcattcattggtgttttattaaggcaaagatattgaggtaattcaagccattgagggttttccctgagaa

SEQ ID NO: 1241 - DNA, 201 bp, Homo sapiens
gattttgcactgaattgttcagtggaactttacattgaaagtctcagtctgtttaagtcatgtgtctgaactctagagagtgaaattgtttaagaattacrtaaataccccatgtgtgcacatgcacgtaattacatttgtaaaaataaagacacatatgcatatatacatatgtgcataattgtatatataaacctcacc

SEQ ID NO: 1242 - DNA, 201 bp, Homo sapiens
tgaaaagttgatttttatttggtgtttgagtttatatcagtgattaaagtacatttgtgatttctgcataagctgtgtctttacacagttcattctgcctkccttcctcttccagaaatgtttcctgccatattctgcttttattgtgctattagtatttttttgttctaaaagcaaagaacgcacctgctaggcagagtt

SEQ ID NO: 1243 - DNA, 201 bp, Homo sapiens
taattttatccctgaactcactcatagatgccacaagcacttcccagtcgatacggttccatgtatcaggcaccttctatagtcccattctagggtcaccrctgttgttgtatttatcatcactgcccagcatctttaccctgcgtcaagaatcctatgcactgcacgttcctccatagaaccttgccccattcattcctc

SEQ ID NO: 1244 - DNA, 201 bp, Homo sapiens
tacaaatcccatgttcaccatattctgcctaattgaaaagggattatcatttgtttgatggaaatataattatacatactattaatatatcaaaccacttrgcctgtttgaacttcagctcatgtggaaaaaaaaaaaaccttgaagctgtctaacttctagagactatttttggtaatgtaaagcactattgagagtgct

SEQ ID NO: 1245 - DNA, 201 bp, Homo sapiens
ggcacgatatttaaaaggaaattgatgtcggtatactatatggagcttactcagattgtatcctttttacgtgaactcagttgtgtgtgtgtttagttccmtggaattttaaccacatgtagacttgcacaatcactgccataatcaagaagcagaatagtttcatcatgaggattcctcctgctatccttgctgtggttt

SEQ ID NO: 1246 - DNA, 201 bp, Homo sapiens
atacaatatatgctctcctatgactggcttctttcatttagcacgttttcacgatttatctgtgttgtagcatgtctcattccttttcactgcctagtaayatttcatggtatggaaataccacatttgtttatccattcattggttggtaggcttttgggttgtttccactttttgactattatgaataatggacatgca

SEQ ID NO: 1247 - DNA, 201 bp, Homo sapiens
ttcaaagaaaacagaaccttggaacagtaatgaggccaggtttataaaactcataaatagcaaagccaggattttaattaaaacctccttggctaaaacamttctctcttttttactgcacaccacgaactcaactctcaacaacagtatcacttggttgtgaggtcaaggcttacaaatatgaaacaaagtgtgaacctc

SEQ ID NO: 1248 - DNA, 201 bp, Homo sapiens
tttgccaagaatgtaattgatcactggctctacatctgaatgtgttcagccaccttctacgtgcccctaggcagtttaattcctctgggaatgcttgggamcttctgcacagaagaatgggtagacctttcacagagagttcattccgtggcagctaccatacctgccctccagaatttatagtctaatcatgaggaaaag

SEQ ID NO: 1249 - DNA, 201 bp, Homo sapiens
ccctttatggtctccacacattgtgatgagcacacattctgtccctataacctgcaccaacatttgggaaccagcaatgcctggccagtgagggaccaggrggagagtcagaactgctctttttttctcaggagagcaattggatcaatttgtgacttcagccaaatcactcaagactctagtctaaatttatctgtttta

SEQ ID NO: 1250 - DNA, 201 bp, Homo sapiens
gcaagaaaaagtcaaaaattactttaaataatagttttaactctggtcgtaggtagaaaaaaagcatcttttttgcttggattcatctataaatataaacrtataccttaaaaataacacgttaaatgttctgtattctacaactattggttcatgcttattacttgttagaaaattcttggcatacagataacatcgtat

SEQ ID NO: 1251 - DNA, 201 bp, Homo sapiens
taacaggtgatatgattgtcttcttatctttatgtgtcaaaactgacaatgacctttaaaatgcacgatgagtgtttcataattctgctctcactaaaackatgactggtgtccttccaccaggaatttgtattactagcaagaaaaagtcaaaaattactttaaataatagttttaactctggtcgtaggtagaaaaaaa

SEQ ID NO: 1252 - DNA, 201 bp, Homo sapiens
agaccaataatttttctatttcactaaagtttgcagtagaaaacaatagtgagaaaaatctaggaatttaaaatcatttttatttacccaatgttaaaaamctcttgtattttaattgagtggttgaccaagaaggtattgactatcattaaggctatttaaatgaaacataaaatatgtgaagttttatgtactttattc

SEQ ID NO: 1253 - DNA, 201 bp, Homo sapiens
tcctgaaaccatgcccccatcagggttcatggaaaaattgtcttccacaaaacttgtccttggtgctgaaaaggttggggaccgatgctctagagctcacrgtcaactaaaaggataaatgaagcacacacataatgacctttacaaaaccagaataaggaagaactgtgggagggattctgagacaaatgctgagctcta

SEQ ID NO: 1254 - DNA, 201 bp, Homo sapiens
tgtgcttgaatcatcctgaaaccatgcccccatcagggttcatggaaaaattgtcttccacaaaacttgtccttggtgctgaaaaggttggggaccgatgmtctagagctcacggtcaactaaaaggataaatgaagcacacacataatgacctttacaaaaccagaataaggaagaactgtgggagggattctgagacaa

SEQ ID NO: 1255 - DNA, 201 bp, Homo sapiens
atacacatatggaaacaggggaatgttagagagaagtcagctgaattaccgtgacctgccagtttaaagagagtacttagacacaggtttcattttgtggktttggggtctgtgtgccatcccttaagtccaattactgctgtaacctcatcttcttcatcatcatcctcatcaacaataaaaaccatctgtcaaatgaat

SEQ ID NO: 1256 - DNA, 201 bp, Homo sapiens
caaatgctattcaagtctgaaaacttcaattctaacctcgccagcaatggtaaggatcgccacactgccagttcttaccagtgctaccaggggaagaaagmaagaaaactggtgactatatgttgccacaatttgaaaaacatttctgtgacacatctatcccataagttatccatgatgacacactagtgtcggcactag

SEQ ID NO: 1257 - DNA, 201 bp, Homo sapiens
tcttaactctggtgtttactggccccataaccttgggcaagttatgttgtcactaatttgcctcacccttaaaatgggaatacctcaaatatattttgagkattaaatgaataaatatgtgtaagtttctttgaatgatatttggcatctattactattattgtccccactggtatataagctctattgagacagaattca

SEQ ID NO: 1258 - DNA, 201 bp, Homo sapiens
tgtcatcacatagatgcttgtaaaaccagccgaatatcaggaataaactatttataacataggttgacatggtactatttgaaatgttttgtggactgcaratgtttcataaggattctttattctttttccttccattccttgatgttatggaatatgtcagaaggcttttttaaggtcaccatatatctaacctcttga

SEQ ID NO: 1259 - DNA, 201 bp, Homo sapiens
tttactacaactggtttctttaaagtgtttgtacttctaatgatattctagaacagttttgaatttttttctctttgtcatcacatagatgcttgtaaaaycagccgaatatcaggaataaactatttataacataggttgacatggtactatttgaaatgttttgtggactgcagatgtttcataaggattctttattct

SEQ ID NO: 1260 - DNA, 201 bp, Homo sapiens
gtgaatgtggtgtgtttctttgcagctgttgccatagaaataaagaccttttcaaagtaaaatgaggatggcataagaattacaaattcaaaagaagttaygcttctaatttaatatcaaaaatggtgcactattccctttctttttaattttgtcaaaattgcatgacctgagtgcgtctaatatacttttattagataa

SEQ ID NO: 1261 - DNA, 201 bp, Homo sapiens
ggtcttggatcattcaaagagtgaatgattcatcaaggattaaaaaagaatttcctcaacttctaatcaaacccatagctgggtcctagacttagcaaaastgtggaggaggagatcagagtcatggtaacatctaggaggcccgtaagtgatttatgtatgtgagtttgtaccatatcttagtacttgagtctcgcatac

SEQ ID NO: 1262 - DNA, 201 bp, Homo sapiens
tgaatttacaaaaccaaatatgaaactcggtggataaaaataagcaaatctgcatttatccctgcatctctgtttgcagagctccatggtggactttggcygcttggtgtctcctaaaattggatcaaatatagttactgaagcaatgtagtaagacaggaaaaagggggaaaggctaatatatgttcatgtcaaacaaat

SEQ ID NO: 1263 - DNA, 201 bp, Homo sapiens
ctcctgtaaacataagtgagttagccttcacatttctttacttattctattgaccttgccttcaaaaaatatctagaatctgaccaattctcacacctctrctattactacttggtcctagttaccattataaatctcttgattttttcagtagccaattaatggtctccctccttctccccttgctcttcttgcgtgatt

SEQ ID NO: 1264 - DNA, 201 bp, Homo sapiens
ccaagatgacacctcactcttgcactctgttgctggatcctaattttgatcctgaacagaaactttatgttttaaattccctgtaacttacccctctatcytgccctgtcttgctctcaatttatcctctctgcctgtgcctgtcctttttcccctctctgggcaaccatcctcttgattgcctccttgcaacatttttgt

SEQ ID NO: 1265 - DNA, 201 bp, Homo sapiens
atatactttacctaagacagcacaagtaatgaattatgttattaataagtactggggtatattgatctcattaggtaaaaggacatcaaagtcattgcttmtatgaaatcaacacatacaacaggactcacttaagcaaaattttccttaagcttatttgtttttacagggcttgggatatttttcaagtgaaattgtgcc

SEQ ID NO: 1266 - DNA, 201 bp, Homo sapiens
agccaagcaggtggcacacacctgtaatcccagctactcagaagaggggctagctctattaccgtgacctgacagtttagagaaagtacttaaatacatgyttcatttgtgggtttggggtctgcatatcatcctttaagtccaattactgctctaacttcatcatcatcatcctcatcaacaacaaaaaccatctgtcaa

SEQ ID NO: 1267 - DNA, 201 bp, Homo sapiens
agaagtttaagagagttgaatgtggagaatgagttctagatttctggcatgagcatgaagagagtgtggtatggatttattgatttggggcatggtggaaraggatccagttctggagggaggatcctgagttcagcatttgatggggtaaactgtggatgcctgtgaggtagcagtggttccatcaagcacgtcgtgggt

SEQ ID NO: 1268 - DNA, 201 bp, Homo sapiens
taatccattaaattcacttcaattaatagagaattacataaggaaaatttttccatttcaaaattgggtgacctttatagttccacctcactgatcctctrgagttctcttcatttgtcagacagttattgaatgactgcaaaatgtagttctgtgaacttattttgtactagtcaattcaatcctggacactgaatatgt

SEQ ID NO: 1269 - DNA, 201 bp, Homo sapiens
aaaatggatgcttctggcagaaaggaggaaggccagtagaaagaagttaaaaagagacgatacttcaatctatatttttaaaacttaaaaaaaaattattrcagcatggagcatttttctcctcttaaacgtttgattttcaacacctcactcaattgcaaattgagtgatattgtataaaccatcttcacagttatcagc

SEQ ID NO: 1270 - DNA, 201 bp, Homo sapiens
atgggctggcctcctccacaggacactcctgtcctcccaacacagactgcttgagaccccctagagaacacagcctgctctgttttccacgggttttttcmaggagagcccagcccatctgcgtctctgtgggagcggccctggaggggacacacgtggggcagtgggtggagcccacatgggggatgagagcggctaatg

SEQ ID NO: 1271 - DNA, 201 bp, Homo sapiens
acatggactctggggagagccccctccccattctgctgttggaagaggacgctgttcccccttggaggccccagagctgatgagtgatgctggctagcccrtggacattgttgaggcagggcccaggggagcccgcagaggggctgtgagacttgagtccagtcacccccttccatgcctaagtctccctgtcattcaaag

SEQ ID NO: 1272 - DNA, 201 bp, Homo sapiens
ggggtctcccagcaatcagggaccaagactcctgtgtcaggggtcaggcctgagcccagggctccagggagcagtagcctgactcccactccctcgtgcaraatcctgccctgttcctgcccccacctcatgggctcttcctctgtgagctgggctgtattcgttgtacgtctggctagagatggggctgctccacacatc

SEQ ID NO: 1273 - DNA, 201 bp, Homo sapiens
tgaatgtatcatttccttcaataatgaatgtagggaataaaccacagggtgacagcctatctgtgactgtctccaacagaaatagagaaatcacagatacrttcatatcatgtcacaggtgttgcagatgtcttaaaatattgtcttcaatcctcactactttaaaagcacagaaaaggccaggcatggtcgctcatgcct

SEQ ID NO: 1274 - DNA, 201 bp, Homo sapiens
gggtgatgagaattaaaattattaatagacattgtccttaattttaagaaaaatttctgcttaattaattcacaaataagcaaagagacaaagtataattygatgtcattagtgcaacgtggagggctatccacaggcaaaggcgccagggaagaaggagcataggcctgtctcgagggaaggttcatatcagaggtaatt

SEQ ID NO: 1275 - DNA, 201 bp, Homo sapiens
agcaatattaaacaggagaagaaagttacctgcgagtcagaagaaaataattagattagaatttgcactaaaataaggccagcctttcacatcatcatcayagtaattttaaaagcacaaatgaaagagtgcctgtaacaaaatatctgtcctctttgcctgccagatgcccataattccactacttatgcatttgtacat

SEQ ID NO: 1276 - DNA, 201 bp, Homo sapiens
ggaataaagttgtaattgctacctctatattcctatgaagtcagatggctttgccagcccagaagacgaccagtggcccgtgcctctcctgcatgcacagyagcaaaacaagcgccaggactgtgggattctttattccaacagagtgtgagagtgtttgtctcaagtaatgagccagacaatcattcctaaacacctgct

SEQ ID NO: 1277 - DNA, 201 bp, Homo sapiens
ctgtgcttgattttgacacttactctgctgttcttcaaggatacattccagtctcccagagaggatgcaatgaggacccccagagcttgaggatgcctctyctactggccctaacaaggatcactgctgtgtcaggcactgtgctaagtgatttgtggacatttttgctaatctgtactcccacctgtgaagtattgccct

SEQ ID NO: 1278 - DNA, 201 bp, Homo sapiens
ttctgctgccaccaaccagggaatccatctctaggtatcaagactgggcaagtctgtaatccatgaccttttgttacctgtgtgtttgctaggaaatatcyggatgtgcgccagaggagataaaatgaggcttagcacaaacatgctgctgcccagacttaacagtggtcaaaagcaatgcttatgcttataagaactgct

SEQ ID NO: 1279 - DNA, 201 bp, Homo sapiens
tgtatgtaacagtataacttaaagctttaaagcataattttaacaaacatataacaataccatttataggatttagattgatttttgctaccttacagtgycatgaaaaacaaatatatatgtgttcattgacaaaagctcataggttaaaacacactgtacatgacagtaattgaggcagctgtaggaactatggtagga

SEQ ID NO: 1280 - DNA, 201 bp, Homo sapiens
caataccatttataggatttagattgatttttgctaccttacagtgtcatgaaaaacaaatatatatgtgttcattgacaaaagctcataggttaaaacayactgtacatgacagtaattgaggcagctgtaggaactatggtaggaataggcaaattgttacagattggattcctcagaagcagacactgacagagtttg

SEQ ID NO: 1281 - DNA, 201 bp, Homo sapiens
agatgtgagtgtgctcctcatgaaaacctggtgttttccagcacatggcacttgccaattctatacgatgcacctctaaaacaagtgagaagacatctctycaaaggacccatgtgccaccagcagttgaggggtcaccggattcttggagacagagctaggttgaagggatgggtctgacacgtgtaaacttgcccaagg

SEQ ID NO: 1282 - DNA, 201 bp, Homo sapiens
aacaaagttgttgtcttagtccactgggctacttaacaaaataccataaactaggtagcttataaaaaacaatattttgtttctcacatttctggagaccsggaagtccaagatcagggcagattcattatctggtaaggccccactttctggcttacagatggtgacttcctgctgtgtcctcacatggtggaaggaatg

SEQ ID NO: 1283 - DNA, 201 bp, Homo sapiens
ttattgagattctgaagtgctgtaatccaggagaaagggtaaattagaaggaaatcttctgtggttgacaattactttggtggtcatcaacaaccatgccygctggttttcatgtccttgtgttgtaagtcatgaatctgggatggctctctgacccaatttaacccatagaatatggcagaagtgatgctgtgcctaaat

SEQ ID NO: 1284 - DNA, 201 bp, Homo sapiens
caaggaggcattcaggtggcttcggggagtggcagcctgtgggggcgcagccgagccccttcctgagggctttcctttgcttcctggcccactgcgctgtyccagcagagcactgcagcctcacagacagtagttcccttgctgcttttctgcctctcccattccatcagttccttgagggcagacactgtgcctggtctc

SEQ ID NO: 1285 - DNA, 201 bp, Homo sapiens
gtcatacatgtagtccatcaacatattttgtggacggttcacattcatataagttccaatacataataataattattaaatatctaaaaaggcaggtttamtagtagtatctgtttgctattttcttccactaaatcttgctaaattgagttttatgtatgcaggaagacagagaatatgtttttgtacatcagcatgcaa

SEQ ID NO: 1286 - DNA, 201 bp, Homo sapiens
gggtttgcgtgggaacccaacctctgggcgtgacactctttccatgggaagatactgcagaggcaggtccagataattacacacatccacctgatggcacmtcagggcctgcctgcataaaaatgagaataaacttccttgctttggaagctgacaaaattgatcaaaattcacatggacaagcagaatctgcccagtagt

SEQ ID NO: 1287 - DNA, 201 bp, Homo sapiens
acggctaataggaaaattatctacgactatgatctctggccagaactccccaaaaggcatttgttaagatggcctagatggcctctaactctatattcttyagtcctaggatttgaattattatgttgatttgttcatttatttgacaaataaaaattgtgtatatttatggtgtacagtgtgatgttttgacttatgtgt

SEQ ID NO: 1288 - DNA, 201 bp, Homo sapiens
gccaccgtgcctggcctactacccttttttttttttttttaacaaggtcttatcatgaaaatatcttgatgttattaaatagcctgatttttaatggctgyggcctacggttattttgtaatttatttagtcacattgcaagctgttattgaacatgtaagttcttttacttattccttatacttaatatacatatattat

SEQ ID NO: 1289 - DNA, 201 bp, Homo sapiens
gtatcaagattatgcctcatgaaataaattacgaagtattcctttgttttttacttctcttggagagtttgtgtaatactgggattctttctacaggattytgaagaactttctgggctagcatgtaactgtgcaaattttaaactattgatttaatttacttaatgtttatagaccagttaggtttcccttcttttttat

SEQ ID NO: 1290 - DNA, 201 bp, Homo sapiens
atttatcatcaactggaaatcatattggagggaaaaatgctacaaagagcaactgcaaccgtggaatgattaattcagtgaatcacccgaggaagcgggcrtactgccagtgctggcctcaggctccatgccaccctctgctctgatggggatgccaaccctcccaggttcgctgacaaatccctcaggagaggaatgggt

SEQ ID NO: 1291 - DNA, 201 bp, Homo sapiens
caggcataggccttggtcctattcccaccttccacactaacttgctgtgtgaccttgagcaaatgactttacctctctgagcctcggttctctcacctgtrcctcacagcggtgttgtgactgtgtcctggaaccactccaggttctgtctaagctcccaggactattgcgggaaggagggaggacaaggactagacctgc

SEQ ID NO: 1292 - DNA, 201 bp, Homo sapiens
gaattctgactgtgccctgtgacctgcgctagctcctcaaacgttgatcctcagcttccacagtgacttgtataccataagtggcagcttttattatttaytttgataatattcccaactagaacagaaacattttgggggcaggcatgctgactaattcactttttaaaaaaatccatagcttagcacagagcttggaac

SEQ ID NO: 1293 - DNA, 201 bp, Homo sapiens
aaaaaaaaaaaagtaaaaaccattcttacttgtggaccacacagaaatgggcagtggactgcatttggcccataaaccctagtgtgttaacccctgtcctrtatcagtggttactattttttcaggccaaaaaccatttggacaatctgatgaaactgatgtacctctctctaggtgggaaaagcctctccactgacatac

SEQ ID NO: 1294 - DNA, 201 bp, Homo sapiens
tagatagaaataagaagcacttaattaaacaaacaataatccattaattggcaacagatgtgtcaaagttggtacaagattccgattcacttacagttaaktttaacagaacatagagtcttcatgtccaggagagtgagcccagcccagcaaatccagggtaaatattacgattaacagtcaccatcctgagatggtaaa

SEQ ID NO: 1295 - DNA, 201 bp, Homo sapiens
agaggctgctgctcctggtgtgtgaaatcatcccccgaattatcaattgaaggaagattgcatcgtaaagccctggagcacgagcctcgttagcacgctcsttccagcacagccggggctcggtccgtctggccatgtatttggcaaccagtgtgtgctccggcccaccctcaactaatgggtgtttgcatgggtgtgcgt

SEQ ID NO: 1296 - DNA, 201 bp, Homo sapiens
ctttctgggcctttgcagatgaaagaggacagccctgctgtagggtgacgccatcatcatctctaaggactgctctcagggacaccatccctgaagtgtgrgggattcaggggctcccctcatctaatttgaagcaccttttgtttttccctgtggggcctggcgacagggtacttctgtggctcagcaggcagcaggcag

SEQ ID NO: 1297 - DNA, 201 bp, Homo sapiens
atgacacgtaagtgccagttccctgtgagatcttgagggtgtggacaggtggccctcagaggcattggctggaattggatcctttgctgaatgctgcataytttaggaatggacggaggagcttcctgaggtggagaggaggtcagtaatggggaggagagagggcaggaagggaggcaggagaccggtctgtaaaatcaa

SEQ ID NO: 1298 - DNA, 201 bp, Homo sapiens
agaatggtggaaaaattcacatccataaaagggtttctaaagctaggagccttgctaagctgcctgagttgtcacattgcagagtgcacggaatggccggytgagtctcatcagtgtggtggtggttacacacgctcattttgcctgatcaaatcgtttcattaaaaattcttaagctgtagacacaaaagtactttttca

SEQ ID NO: 1299 - DNA, 201 bp, Homo sapiens
ttcaacacagtactggatggtctagccagagcaattaggcaagaaaaaagaaataaaaggtattcaaattggaatgaatgaagcaaaatgatttctattcrtaaatgatatgatcttatatgcagaaaaccctgaaagttccacacaaaaaactatcaggataaaggaactcagcaaagtatgatattaaatcaacacaca

SEQ ID NO: 1300 - DNA, 201 bp, Homo sapiens
gattaagcaaaacctacaaaaaacagtattaagttttactgttttatgtaaactgattttaaaaaatgagtttgttcatcattgtcgagagaacatctgayaccaatgaactctcaactactttaaagtgaagaattaacacaaaattacctttgaaggtttcaagttccttcctgtaggaaaaaaaaaaaaaagacaaga

SEQ ID NO: 1301 - DNA, 201 bp, Homo sapiens
tttacaactgttctttcctcttcctggaatgtctttgttatcctttctagcccagtgagtactcgtcattcagatcaagtgtcatgacctctctctggttrattactcccaccttagtgtacttatttctattatttctatattatattcaaattatatatttgcctttctaatctataagctttgccacagtcctttagc

SEQ ID NO: 1302 - DNA, 201 bp, Homo sapiens
accacacctagaattccatgttcttaatcatctgctacactgcctaatatgtacacatatatttgggttaatctaaaatacatggtttaaagattaaaccwtgtttatcccctaaatagtagcaaggctattgtccacttacttttttttaggtatgttttatagtcaatatcaaaatcaagaaaattacaatgatcaaca

SEQ ID NO: 1303 - DNA, 201 bp, Homo sapiens
aaaggtttacaggaatcctaccttatggtcaaactgattaagactggacaaatttatctaagggttttactaagaattgggtttaacattcatagtacacwaatacaaaggtgaaatctggcccatgaagaagaatttcatgtaatattaaaagacaatgaaagatttttgtttgcctaagctacaaaaaagaggcaggaa

SEQ ID NO: 1304 - DNA, 201 bp, Homo sapiens
agagttcaaaatgttaaaagagaaacagtaacacttactacatatgaattgagaaaaattctagtaatctctctattaaagattaagagcattgttcattmgagataaataagactaagaataaactttaaaaactaacttcaatatttacaattcaggtgtttttatattgagttaggaaatatgagttttgtgatatta

SEQ ID NO: 1305 - DNA, 201 bp, Homo sapiens
atggattttaccctgtgcctaggtgatgtccatggcacagctgactccttaaagggggaacatctgggtgagcctggcctagctaggcttgtgaagggcaytgggccttcttggagaaagatgtgaagcgtgacagggatttgacacagggccattatctgttgctgggttggaggatggagggggccacgtggaaaggaa

SEQ ID NO: 1306 - DNA, 201 bp, Homo sapiens
ttgctgtaataaaatatagattttatttttgataaagtttgatcaaatattatctcatttgaaacaacttgtttgttgcttgcattttctaaaaattgagyttatttccatagtttaatagtattttcagaagatcaaacaaaaaattgaaatgtctcattttaaatgttaacatatttcaaaatttactcaattcagcta

SEQ ID NO: 1307 - DNA, 201 bp, Homo sapiens
tcataagccaatttcatccctagctttaaatgccatccatatgctactaacttcctgattacatttcctgtcttgatctcttctttgagctccagactcayatgcaactgcccatttgatagctttatgcaaaagtggagtaggctactcaaacatttgcaagacagcctgttcttctccagtcgacgtcatctcagttaa

SEQ ID NO: 1308 - DNA, 201 bp, Homo sapiens
acatcctcacattagcaattccccgacgtggggaaagttgacagaacactcagttcaatattctaatgagtaattctttttttttttctatgattacaatstttagagagcttctaattttcttcttttagaatgtgtgactgtgagcagaatttctaaagggctctcttgttttaaaaagctgaaactcagaataatgat

SEQ ID NO: 1309 - DNA, 201 bp, Homo sapiens
cctatctggataccacttctttccattttctttggtatcataatgactccttcaatatcttcaactatacctcccctgactttgacccggatcccatctcrttacattttcatttttttctaccattcatgattgaatagttagttcatgtcacctttatttcctaactactcatacacttctttttttggagacagagtc

SEQ ID NO: 1310 - DNA, 201 bp, Homo sapiens
aatgaaaaaaagtaaatttatctagagttagggccttcatatgagttttcagaaagtgaaaatgatcacagaagctccgaagagaggatgctgctctgggygacagcgggagctgcactggctgcactgaaggagcccagaaatgcctgaggccttccattccatccctggggcagcctgcacacccggtgtttccaatta

SEQ ID NO: 1311 - DNA, 201 bp, Homo sapiens
aactttaagaagtacattaacttgcaaaagccattatggaacaaatgagatctatgtagtagcctaaaaggtgtctaagagaattaatgtgcctcttgaarggtctagcctcagaaaggaacctggacatctgataatctagtccatgaaaaactgacagagctatgataatctctttgttagatgccctctaaaattctg

SEQ ID NO: 1312 - DNA, 201 bp, Homo sapiens
ttcaaggttactctgggtccccttggctaagaggagatctgttcagtcagttacggggcttaggattttatttctcactcccctacataaatacgcacacragataaaacactttcctctttgctggaatctcttaatgttgatggtcaaaaggtcctatatttaccatttaggatgttaagaatctaaaatgatccagca

SEQ ID NO: 1313 - DNA, 201 bp, Homo sapiens
cgagaccgcgccattgcactccagcctgggcaacagagcaagactttgtctcagggattaaaaaaaaaaaaaaaaaaaaaaaaaagggaaccgaaatatcrcaatccagaaacaggctggatgtgggtggcaggtgcagtggacgtggtgtcctggcagctgccctttccgtcagccctcctagccacctctggcaccccc

SEQ ID NO: 1314 - DNA, 201 bp, Homo sapiens
accacaaagagaggatgcagtattgagcttaataaccttgaacttactgctactcagttcttatcaaaaatatccttttgcatgaagtaatattcataggraacatcctgaaaagtatctaattcagcactccacaaagaatgtggaatgtctatgcttggacagagccagcagtgagctgcttgtctgaactgtcttgct

SEQ ID NO: 1315 - DNA, 201 bp, Homo sapiens
tgaatatattgaattacaaaaaaataatgttgaaatgtatttgaatcaaatgatttaatatactggtaagaaaagctgagttgatgggggaaagggaagaygctggtcaaagggtacaaacttccagttatgagtaagttctggggatctaacgtacagcatggtgacgatacttaatagtactcatttcacagtatatat

SEQ ID NO: 1316 - DNA, 201 bp, Homo sapiens
ccttttatggaattctaggccaggcatctacatgctctgtgcctcttcctggctttgtctaccttgaacctaccctaaccccatgaccccagccccttcasacccaacctgtttctagtactagcattgagcacctgtgcctagtacctacttggacctacacattgccaaacattgcctgtgcctgtgtgacctgcccct

SEQ ID NO: 1317 - DNA, 201 bp, Homo sapiens
ttcccagctactagcaaaataaccgatactgtatttaacaaatggatgttgaaaaatgaatgaacctgattttagacagcacagcaacagactagatcagygtctttcaaactgcagttcatgactagataagtgttttcaaaatgtatgagttataaccagtactttttaaaatgaaaatgaacaaattatcataggaaa

SEQ ID NO: 1318 - DNA, 201 bp, Homo sapiens
caattttaaatgtagtgatagaaagccttaactcaaagttgacctttgagttaagacatgaaaataatgagagcaggcatgtggatacctaggaaagaacrtcctaggcagaaggacaaagaccaggaaaccacagtccactgtgtggataagctcaaaaatggagatcatttagagtaaggatagaactctgggaacatc

SEQ ID NO: 1319 - DNA, 201 bp, Homo sapiens; identical to SEQ ID NO: 1217

SEQ ID NO: 1320 - DNA, 201 bp, Homo sapiens
ctcatgatccacccacctcggcctcccaaagtgctgggattacacgcgtgagctactgtgcctgacctatgatttatttttctaatgtaatatgtcatcaytgtatgaaccatttttctaactttgacaatttttatttttcccttaatctcataagcagttttcatatagggtcattatgcatttttttttagaaaaata

SEQ ID NO: 1321 - DNA, 201 bp, Homo sapiens
attttcaatgagttttggattttctaagggcacacacagagagaataactttaggctacttcttgaagatataattcaatgatttttaaccaatatttatrccatccagcatcacctggagtatagccaatcaaacaaagcatatgaaccaagtaatcacacaatatctgcattgatgtgttgcctacatgcagcagaatg

SEQ ID NO: 1322 - DNA, 201 bp, Homo sapiens
agagatcccctgcccacccacggtaatgaaacatgggtacaggtgaaggcaaaagtggggactgaccctttggagatggctgatgtcacgagtgtgcaacytgtgcagttccacggggccccatgcttagaaaggttccatgtttggtttaaggctctgctgttgccatcttaaaattcttcgtaagttttgaacaaaggg

SEQ ID NO: 1323 - DNA, 201 bp, Homo sapiens
gaatatgctcaagtcaaagtccattgttcgtattatcattattaaacagggaccatttattaagaatatgccacatcccagaaagtgttcaaataaattakttgctctaatcttctcaacaatgcctttcgaggcaagtattttcaccttcatctttctgttgaggaaacctaggttcagaaactttaaggaagttccttg

SEQ ID NO: 1324 - DNA, 201 bp, Homo sapiens
cattcaaccgccctttctctgagaggaatctgttttctttacaaagaaaaacaaagggtatacccttttacaccgaaactacaatgcccaccacaacgtgycttttaaaaattactcattctccaagcaagaaaaggtcatggacattttcaaattatcccaccacccctatgtacagaatttgtaagttttctaccaagt

SEQ ID NO: 1325 - DNA, 201 bp, Homo sapiens
ttactcattctccaagcaagaaaaggtcatggacattttcaaattatcccaccacccctatgtacagaatttgtaagttttctaccaagtaacaagtgacrtggccataaattatgcaaaaaaggataaaattcatgtaaataatagctcgcagtcaggatattaaagtctatttttaaagctttcaaaattttttttgtt

SEQ ID NO: 1326 - DNA, 201 bp, Homo sapiens
acgggaaccctcccaggcagtgcgtacatcatcacaaggttgacagcgatcattaaagacattattttccttttaacttacaatctgacttcctataactkctaccttagtttttctttttatacataaaagttatgataacccttcagtctccacctttccaattaactgagaatagctttcctatcctccaccaatctt

SEQ ID NO: 1327 - DNA, 201 bp, Homo sapiens
atctcacatagagcatcgaccatcgaacgcacgtaggcactcaagttccaaagtcactcagcttccaaaacacagcctacagtatgatgaaataggactcytactgtttatatttcttgatatatacactcacatttttaatatttatattgtttagaatatttattaggccttgtctacactcatgatggactattaaag

SEQ ID NO: 1328 - DNA, 201 bp, Homo sapiens
cgcacgtaggcactcaagttccaaagtcactcagcttccaaaacacagcctacagtatgatgaaataggactcctactgtttatatttcttgatatatacrctcacatttttaatatttatattgtttagaatatttattaggccttgtctacactcatgatggactattaaagtttattactttttaaaaatgaaaacca

SEQ ID NO: 1329 - DNA, 201 bp, Homo sapiens
ttacctgtgagtccctctgcctgggcatagggaaggaaagtccatttcatgacatcagcaacacaaagtggccataaaacacactggaagcctgaagactyaaaggagttagctttgcacgaaaaggcaaacctagggcttcagcatcacgatgtcagaatactaacatttgggaaatgaatcctgttaggccttcacaca

SEQ ID NO: 1330 - DNA, 201 bp, Homo sapiens; identical to SEQ ID NO: 1084

SEQ ID NO: 1331 - DNA, 201 bp, Homo sapiens; identical to SEQ ID NO: 171

SEQ ID NO: 1332 - DNA, 201 bp, Homo sapiens; identical to SEQ ID NO: 1089

SEQ ID NO: 1333 - DNA, 201 bp, Homo sapiens; identical to SEQ ID NO: 1090

SEQ ID NO: 1334 - DNA, 201 bp, Homo sapiens; identical to SEQ ID NO: 1091

SEQ ID NO: 1335 - DNA, 201 bp, Homo sapiens
tcatttatttagtacatgtgtattgtgcacctcttgtatgggtgggaacacaccaggttccaaaaataagactgggactatgataaaatttttactctcargggtaacagttaagtaaataacagccacaatatggggtttgagaggtacacaaccactaaaagagaggaaaagggacacaattttgtttgagaactaaca

SEQ ID NO: 1336 - DNA, 201 bp, Homo sapiens
aagacaggttcagagaggtatgaactagcaaagtaacacatttatccaatcaacattttttacccatctcctacactgggtctgaggacacagctatcacrtaacatttgacctcctctagtatcctacagaaaaacaactaaagcacctttgtgcaactcagaactacaagctcttccttatgatttggacaacaggtgc

SEQ ID NO: 1337 - DNA, 201 bp, Homo sapiens
atttagaactctgtatgttcatatgtgtatgtgtgtatgtgtaaaaataaaacttgattggcatgacatcatgggtgctgggagtgggtctggtaaccagrataaaaagtggtcttctctgtcccttgtctagccacaattaggagagagtatggattgtcaggaaatggagcttgttccaccctctcactgtggcttaag

SEQ ID NO: 1338 - DNA, 201 bp, Homo sapiens
ggtggctcaatctctttcagttcctttcccatcttgttgccacctcttttgttgctcttgaaatattttctagaggcacaaaacaaaaaagtgattaaaaytgggtaaattttaatacttataaaacattctgcattaaagaaatactctttaaatcaatacttctgaacactttcttttagacaacgtttatgaccaatt

SEQ ID NO: 1339 - DNA, 201 bp, Homo sapiens
acattattagatttcttaaaaagaatttttgtgcttttatcagcatctgaccaatatctacaggactgacttctcctttaggcacagagttgagggaccamaaaattacttcaatttctcttaaaaataacaagggaaaatattaatataattcagtatggattatattatctttatactaacagagtcacaaaatataat

SEQ ID NO: 1340 - DNA, 201 bp, Homo sapiens
cattaagaactaactgaaagaaatgcactgcttggattcatagacagacagagggacaaacagatggctagatatgtgataagcaacaacagtatggccaratgtcaatgatagaatctaggtgatgggaacatgaatgttttccatgaaattctttcaacttttctgtgtatttgaaatttctaataataaaatgttgga

SEQ ID NO: 1341 - DNA, 201 bp, Homo sapiens
taaataatatgcccatggttcctgaactagcaatggtcaaactggaattggatcccaagcagtggggctccagagtcgcagcccttgaccactgcactcakctgtttctccatcttcccaacatacagccactaccttcctgccactgtaggtcactcacttcagtactacagctcaggagtctgtagggacctgacgcct

SEQ ID NO: 1342 - DNA, 201 bp, Homo sapiens
ttttagattgtaacccctacttggggcaaacctacaggatctcaatgacagaggtttgctttcttagtaaacagccttggaaattccccctcatcttcctwcatgggtctggtgttcttcatcattttaccagtgacttatatgttgggagagaaaacctgcttgctagatattaagcttattaagagaagaggataggag

SEQ ID NO: 1343 - DNA, 201 bp, Homo sapiens
gaactaaaaacaattctaaaaaataaagtcatatatatgtgtatgtgtgtgcatatattcacatatacgtatatgcatattatatatgtatagatacgtgkaatgcatatatacataaacacacacacacacacatatatatacacatttatacacacacatacacacacccctaataacttttaaggacaaaaactttct

SEQ ID NO: 1344 - DNA, 201 bp, Homo sapiens
tttccctttttttggtctataaatcttcttccatcacgtggctgcactgaagtctctgtgaatctgctgtgattctgggggccgcccgattcaggaattgytcattgctcaattaaatacctttacatttaatttggctaaagtttttcttttatcaccattgccaggcctccttggaacacctatctcccaccattcatt

SEQ ID NO: 1345 - DNA, 201 bp, Homo sapiens
actttgggaaggggatgagtaaactttatgtgagggaagaagaaggctattcagctatcagaagggtaaactacagtagagtctgttaagtgctaatcaarctcatttccttttcctcttgggcccatagctaagctacattttcccacctttctttcagattgatgtacaagtgattgagtggcagccaatggaatgtgg

SEQ ID NO: 1346 - DNA, 201 bp, Homo sapiens; identical to SEQ ID NO: 1069

SEQ ID NO: 1347 - DNA, 201 bp, Homo sapiens
tacttggaaagatcaaactgtttccaagtaatttaactgtagctcacaacaaatctcaagaatacttagagaacaaaaatatctagcatgcaacaggtagmattcattatgtctagcatccaatcaagatataccaagcacatatatttcctgcaaagaagcaaggcaatacccacaatgaagagaaaaatcaagagagac

SEQ ID NO: 1348 - DNA, 201 bp, Homo sapiens
atttgaaagatcagtttgctcttgcctgtttttctatccatgcactaaacagcagtttataaattgcgatgtagtgaataatttttcagccttgaaaagascatatccataagaaataaactacaaagacttaattatgtgaccaaagtctggtagggtgatatatggagaagacaacctggctcctataaccctacccca

SEQ ID NO: 1349 - DNA, 201 bp, Homo sapiens
acaagacacacagcccgatactgagtcgcatgactacgcaggcatttcagagtgaagtcaaggtgcttaggttcctactgggccgccaagccattcagcaycagcgccggtcccatctgcaggcaaagaatgacacaactacctcttcatggaatattcccagtcaaagcccacttaataacgaggtccttctgcagggtt

SEQ ID NO: 1350 - DNA, 201 bp, Homo sapiens
ctgtttcaattgccacgtgtacactggtacatccaaatccacatgttcaaccagtactctctcctgagtttcccatatacctaacttctttctatacatcscaactcagcatccttcaagcacctctacgtattagtccattttcacaacgctgataaagtcacacctgagactgggtaatttataaagaaaaagcagttt

SEQ ID NO: 1351 - DNA, 201 bp, Homo sapiens; identical to SEQ ID NO: 870

SEQ ID NO: 1352 - DNA, 201 bp, Homo sapiens; identical to SEQ ID NO: 881

SEQ ID NO: 1353 - DNA, 201 bp, Homo sapiens
ttggctgtccctgcttctccaggcaagcttttggaatattctgaataagagctggagagtcaaagaaagagaaaacaaagcccctttctatctcccatacktttccttcctgcaggaaaagggacacagtaccatgcagttgaacaccatgtcaagtgaggataaaggaaaacagccatgacatcactccattactgccac

SEQ ID NO: 1354 - DNA, 201 bp, Homo sapiens
ggataaaggaaaacagccatgacatcactccattactgccacccccagtgtgcctcacaggccctgcaatttataatcttgtttaatcctccaagcaaccsaggaatacagatatcatcgcccctgctgtacagataaggaagcagaggctcattggggtccaggagcatgcctgtggacaaatagctcctaaatgacatt

SEQ ID NO: 1355 - DNA, 201 bp, Homo sapiens
cagcaaagcaggacagggtgagggctgccccagctgtgacctctgggtctggagggttgaccataggagggtctgggccatctgcagagaattgagaagaycaggccagagggaagaggaaaggcctttgtccatattacaatgcattggccattgtctcagatgacactcttccatccccctccagtgcacaactgcatt

SEQ ID NO: 1356 - DNA, 201 bp, Homo sapiens
ttctcaaatcttaataaattgccttcaaaaaaaaaaaaaaaaaaagagggaaactccttctctggccttgtaagtgttggagccctctccaatgtatgccrcagaatttttctctcggtttctcagaggattatggagtctgccttaaaaaaggcaagctccggacactctgtgaagtagaatggccaaagtttggagtcg

SEQ ID NO: 1357 - DNA, 201 bp, Homo sapiens
tgcaaaacctcagctggaaacatgctagtttatataacaaaaataaggttatattatagatctatatgcatatcttataacctaaatgaggtataaagatktatcccaatagccatatacacccagctcacagaatagaacatgatcaataccggtcagtcagctcttccatttatctttctccaatcttatacctgtgtc

SEQ ID NO: 1358 - DNA, 201 bp, Homo sapiens
atcctaagggctggttttaccctcttttcattctgtatgtcctcccccacctgcctgtgaagctctcaaggtcctgccagctctacacgtccccaactctktttctcccctccctttatactaggggttcagaacttccagccagaagccactgcccttgtactaccttgtccccaacccctttgtcccctctgcccccca

SEQ ID NO: 1359 - DNA, 201 bp, Homo sapiens
ttctctaggtccagaagcttctctgtgagctgcacaacaggaagggcaggttctgtgctggccctaaagcctgggcactcagcacagcctgaaccctagtmaagacctgagtcggacccctcaacacaaggccacaaaggcagcttagtcaggtggttcccttatattccaataacagatacaagacaaaggccacattct

SEQ ID NO: 1360 - DNA, 201 bp, Homo sapiens
ccgtgtatatgttatcttacatggcaaaagggactttgcagatgtgattaagttacagatctagagatgagaagactctccaggtgatctcaatgtgatgrcaacggtccttataagaggaaaggccaaaatgagggagggagatgtgatgacagaagcaggagtcagggtgaggtggagccatgagccaaggaatgcagt

SEQ ID NO: 1361 - DNA, 201 bp, Homo sapiens
ctttcattgttaactgcctgctcacccacctttaaatgcttactttctgtaggataaaactaaaactccttattctgatattcgagggtctatctctaaaygctaatgtcttctaatcaaatcaaccctttgcttcagctggaaaggtccatctccaaacattagttgctcattcttatgtctggctttgctctttgtggt

SEQ ID NO: 1362 - DNA, 201 bp, Homo sapiens
tgactgtggccactgggtgtgtactttaggcatctgctttccttactactgaataatgcatgctgcttcctttgatctttgagaaatggtatggaaagacraaccgtgaccgtctgcaggtatgtgtgtgtgtgtgtgtgtgtgcgaacgtgctctgagtaggggtgggaagggctgccccacttcctcccacgccgtgtt

SEQ ID NO: 1363 - DNA, 201 bp, Homo sapiens
cttctgttgaagcctgggaagacagatgtagctagccagatgcactggcttgtgtttcatcattatcagagacatttcaatttcagatctggccaggcatwtatcagctttacctgaaatctcttttaaaatacactttcgcttctaattcagtcagcatatgttgggatctaccctggggaattcagttatgatgaccaa

SEQ ID NO: 1364 - DNA, 201 bp, Homo sapiens
acatatggaagaatggatggaggagagggaaaggggaaaattctgcaagctcaacaaagttagaaaataatatcaacaataaaatatggcctgtttatttwtttttttttaccatcacgtgcaatcctacaatgtggtttcatgttcccttcatttttcctcatggtgcaaatcacagacacatttacaaacaaattcaca

SEQ ID NO: 1365 - DNA, 201 bp, Homo sapiens
aggctctacgcataggttaataaaagctgtcaggcagagcaagactccgtcttaaaaaaaaagaaagctgttaggtaaaccagaataatttattgtctccwcgttgcgtatttcattcctgtttattttcaatgtttatgtgacaaagttattaactgagatattaatttttaactcctcatggtatctctccttttcaat

SEQ ID NO: 1366 - DNA, 201 bp, Homo sapiens
gtttgggtcatgttgagtttggggtacctgatagccatccaaggtacactagacattttgataaatgcacctaaagctcagcaccaagggctgggctgggkccagtgcaaaatctccatgctccatcttgacagtatatttccctttctttatttaaattttctctgtataattcataactgtgtaatcataaccgtattt

SEQ ID NO: 1367 - DNA, 201 bp, Homo sapiens
gtggggaaattgggggagggagatactcaattcacaaaagaagtcttccctccgctccagggaaagagaggagccacgggcggcgtgaggtgctacgagtytggggacacaaggccgtccgaaggaaccggagtccacaccagcggctctccgggtactcctgagtttatcttggaactggggaagaggcgggaagagtag

SEQ ID NO: 1368 - DNA, 201 bp, Homo sapiens
ttagccgggactctgagggcaagtcctgacagtgtgcctggcacacaggaggtgggggactgatgactgatgaggacctctctgtaaggaagagtctgggrgtccgcatggggctcctgctgcctctgttctcccaggtgcccagaaaaaaactagaaaacatagttggaggccaggcaaggagaggggctggaagtgtga

SEQ ID NO: 1369 - DNA, 201 bp, Homo sapiens
tgcacacaccacctccccaccctcccaactggctctgaacagagggagcaggaatggtgcagcggccgggggtccacactggcaagggggcctgctgggargagactgaatgttgagaaatctgagcccagaggaagggcagaggagaatggcacatgccacattctttcctattaacagcaagtttggctgctaacttgg

SEQ ID NO: 1370 - DNA, 201 bp, Homo sapiens
cgccggccagccccccagctagagcctctcagagcaggcacccggcctttccatttttgtcctcagcacctcccagcctgtgcatggactgagggctccamaaacatatttataggaataaatgtttcagggagttcacaaggtggtttaaagagcacgggattggagcccgctgggcctaggttgaaatcctgactgtaa

SEQ ID NO: 1371 - DNA, 201 bp, Homo sapiens
gaatattctccatgatcagagtcattgtacttcactggatcaggcctcctcaaggagaggttggatgtaggatctctacagcttctgggcagcttctgagsagggtctcctggaccccatggcacatgcctgggagacccatggggagaggctagctggggcctgtagccaggcctagtcgcagaggtgcaaccctggtgt

SEQ ID NO: 1372 - DNA, 201 bp, Homo sapiens
agtcagacagatctggtccagggtctagcatcacccctgccgcctgtgtgatcatgggcaaccgccccaccctgcccgggcctgcacctcctcctctgtaratggtgacaatggtagaatggaccaccgggctaaaagctgtaaaagtgcctgtacacaggaatcatcactcagtgaatagctcctgtggctacaacattc

SEQ ID NO: 1373 - DNA, 201 bp, Homo sapiens
aatggggtggtgagcatcagcttgtggcaaacagaattattgctggacggtgcagaagcaaaatgataaaggagcagaatctgaacaggagcagacagagytatttccctaagcttacttggttgattaattgtaccaatgccttagtaaggggaattagggcacgcaccagaatactatagctatatctgtgtactacta

SEQ ID NO: 1374 - DNA, 201 bp, Homo sapiens
cagcatctagaatagtgcctggaacattcacaggtcctccctggtaactgctggatgaacgagcacatcagtcccaaaacagggaattataatggggtggygagcatcagcttgtggcaaacagaattattgctggacggtgcagaagcaaaatgataaaggagcagaatctgaacaggagcagacagagttatttcccta

SEQ ID NO: 1375 - DNA, 201 bp, Homo sapiens
ttcaccacatggctgtagcgtaaaaagagaaagtacaatttcaaagcaaccactagaggcatattcagcaaaacaggcgaagctctttacttcttgaagtwctattaactgcagagatttttaaaaatactattaacagttaaatagaaatactattggtgaaaactctgtaaagtaagtcacaaattttgaaatgctggt

SEQ ID NO: 1376 - DNA, 201 bp, Homo sapiens
ccagcaggtcagatggctgatgtgatgatgatttaatcagcaaggaaaatgagaggaagggtaagaggagatgttggagcaataggtaagagccatactcrtgcaaccccttgtatgtcatgatacattttaaacattttattctgagtgcatttaaaagccactaagaagtactaagcaaggaagtgagggagtggctgc

SEQ ID NO: 1377 - DNA, 201 bp, Homo sapiens
gggagaaaatcaagaatcccaattgggattattatatatgtgagacttcttaaatatactacagccaaaatgaaatgggtataggtctgaagctcagacarcagttgtgaatcataattataaaacaatgtaaacaacctataaatggtctttaaattcattacaaagagagataagagaagagcagagaacccaaggcct

SEQ ID NO: 1378 - DNA, 201 bp, Homo sapiens
gtactacgtctccctaatcaagacatcactggatgtctgctggccaatctgagacatcaacatgctcttcttggaggcggttgcttcctagggagtcattytgaggccaccatgtaggagcttcagggaagagaactcaaaacttgaaaagaaaaactagatctaggtcatattgtttgtgccctaggaaatccttaccac

SEQ ID NO: 1379 - DNA, 201 bp, Homo sapiens
catagtgatagggatgggtacccgtactacgtctccctaatcaagacatcactggatgtctgctggccaatctgagacatcaacatgctcttcttggaggyggttgcttcctagggagtcattctgaggccaccatgtaggagcttcagggaagagaactcaaaacttgaaaagaaaaactagatctaggtcatattgttt

SEQ ID NO: 1380 - DNA, 201 bp, Homo sapiens
ggttacgatagaccaactttctgatcttctgaggtatatggggtttcttgactttttctggtgatttgttttctctgttaaaacttacacttcacacctakagactaaaaactccttgaaggtagaatccatgttttagtcattgcttggatgcctgtaaacagggtacctagcacacagcaggcatttgttatttttttg

SEQ ID NO: 1381 - DNA, 201 bp, Homo sapiens
gtacctagcacacagcaggcatttgttatttttttgttaatatataaaatcatgtataatgaacctgtactttttaaaatgatggacgttatctgcagccrttagtccctcttcctccttctgagaagggcacacaagtttctctttcttgttttttgagacggagtcgctctgtcgcccgggctggagtgcagtggcgcg

SEQ ID NO: 1382 - DNA, 201 bp, Homo sapiens
tgcactgctgacttggagccctctgcacctcctgttctgggcacaagagggcagccaagggcctcagaacgctgaggaaccctggccaactagctttaagmaatgcattgtgtaaactgctctttactgagcccagagcttgccaggagcctggtagggttgtggctctggctctcatttctaccaaaggaagtgtgcttg

SEQ ID NO: 1383 - DNA, 201 bp, Homo sapiens
ttccctactgccctgacgacaatgtgtgagcctgtgctaggagaccaggccctgtgtgataagctcagcctgccctgttccagctgcacccaccttctctrgatcatggactcacttctctgcccacagatacctttttcccttgacctctgcatctggataactcctattcactcttcacctcctgcaaatgccatcacc

SEQ ID NO: 1384 - DNA, 201 bp, Homo sapiens
agtgagtggctctgcctcgcgtgggtggggagcagggatgcgttttcagccaggagatggcttggggtttgggttcagctgggcagccagtgccatggatrtttacctggtgcacttggaggtcacagggcacactctgtcctgatcttagtgcagatacctttcaggtaccgtagacccccccagcctcagcagctggag

SEQ ID NO: 1385 - DNA, 201 bp, Homo sapiens
ttttgtccggccctgagtggcctggctacagcacctcttggccctctgaggttcgtcacccctctgccatcacacccatccctggccaccctctccctgcytgctgcctgctgtctgtcattgaacatgctcgtgtttctcccatcctaaaactcctcctcctggttggtgaacgcaatggccacacttcccactttcctc

SEQ ID NO: 1386 - DNA, 201 bp, Homo sapiens
acacataccctacttatttctgcatcagttgattcatgacataatcaaaatatctctttttcagtttaaaagtttatcatatttgaactttagccaaattrttttcttactaggaataaataaaaataaaaatttcgtatctcggaaaatctaactcttctccattagatagggcctctgtaatatctttcattgtcctgt

SEQ ID NO: 1387 - DNA, 201 bp, Homo sapiens
tgctttctatactctatctaaaatacttagagatgcccttcattaattacaaaataggtggaacactcagcttttataaatataatccatttggtgtattyccaattccattatgagaaaatttagacatatatttgcactaaaagaataacactgaaatgttgtcaaataatttttacttcaatgtttattgtatttcag

SEQ ID NO: 1388 - DNA, 201 bp, Homo sapiens
aagtgtctggctgttgatctgtaaaaccaaacattttcaagcatcgtagcaataaagttcttgaacagccattaatactttagtatctctatagaggtttyaaaatattccttaattcaattccaattgtctgtttaagaaaaataagatgtaattaaatacagatgctttctatactctatctaaaatacttagagatgc

SEQ ID NO: 1389 - DNA, 201 bp, Homo sapiens
gtgaagaataaataacaagctgttaatttattctcatagatttttttcaatccacaacacaatttaaaaagaaatccttctcaggatatatatgttacaarccctatttagatttgtacaaatatgcaagacattttctgtgccttattatgtgctatataataatagtgaaaaatccctggtcttttctagaggtatttt

SEQ ID NO: 1390 - DNA, 201 bp, Homo sapiens
tctacattctgagaaggagccagaagagagagggaatttgaagatacatgttgcataacctctataagtatctcatagattaactaaaatgtgtttgatayttatctttgaagttttattttttatttagtattccttccctcaccagcatacttaatctccattctttgaatgtgtgggctctgtgcccttggacgtggt

SEQ ID NO: 1391 - DNA, 201 bp, Homo sapiens
ctcatttcggggaccccttcatggggctccacctgtctcccatttctagctgaaccaacagctcctttgttttactccaaggctccttgcacagcccgctsttgtagcccttggctgtgctgtggtgcacacagaatgggggcctcccaccacaaggcagtagctgtgtgataccggctaagtcacaggatctcctagaaa

SEQ ID NO: 1392 - DNA, 201 bp, Homo sapiens
agctggatcacacctctcctgaagccactgaaccattcagttatggaagccactcagttgtatttattgtgaatggctatagtcttccttcccaacatttyccctaacctaatggcccaaaacttttagaaaggaggaacctctttccttggataattaccctggtctgttggttttgggttcccaggatgtacacagatg

SEQ ID NO: 1393 - DNA, 201 bp, Homo sapiens
tgttcattggccaccaaatcagacaaaccctgagtctagagcagagcacagtgcactgtagttgtagaatatttatcaaatgaaagaatgaaaccagcatmcatccatcaaacatttgaggcacacctattctgcatttgaccttgtgcaaggcatggagaggaataccgcgtggtctctgccctccagaaacactcagga

SEQ ID NO: 1394 - DNA, 201 bp, Homo sapiens
cttcgtggacttttctttcaccgtgcttatcgtggattgcagccacgcacgtgtctgtgtgatgattcgatacccgtctgtctctctcactaggccatagygtcgtaagagcacttggtacacttgtctttagcttggagccttgcacataggaggtctcattaagcatttgttaattaaatgagtgagtgagttactgac

SEQ ID NO: 1395 - DNA, 201 bp, Homo sapiens
atccaagggacatcatcccactttgggacccaatgctcccactccccagccaagtgccaccttacagtgacactttctgcaattgccaggctatccctaaygcagttgaagccctgagacctcaaggggtggaggcagctggaattggtagcacagcagtttggatgcaggcacctgaactagcttttgagtgtgtgttgt

SEQ ID NO: 1396 - DNA, 201 bp, Homo sapiens
gctggacacacaccttctgctggttggacctccaaatcagcaaggaagggcccgatcccctaagggtcctaaggctgctgtggagaccgcgcactgtctgyagagtgagagatgcacctctttggctggggagcctcttctttgttccccagaatatgtggcaagctgggaggctgcacggaagcttgtttatgcttcctc

SEQ ID NO: 1397 - DNA, 201 bp, Homo sapiens
tgctcaaagtcacctaagtgccacaaagcaggagagagctgagttctaggcttccacacctctcaaagccaactcagcaagatcatctcatacaatctaasttgccatcaattgtgaaaacatgtttttgacacaccactaggaaggagaaaatgctgccaactaaactatgatacatggctttctggaaacatcagttgc

SEQ ID NO: 1398 - DNA, 201 bp, Homo sapiens
accaggctcgagcacatccttttgggagtgctaggatctaattagtgtctggggcctgctgctgccatttctggcttggtctgagtcatcatcaattatcyggcagccgggggccagagcagagcctggcaaggaaggacggagcatctaaggatggggaccgcctgactgccacctgggcaccttgtcacagtgcaaggg

SEQ ID NO: 1399 - DNA, 201 bp, Homo sapiens
ttttcctgtctgttactgtaagttctaaggtttaggacgtcttcacctgtctcagagttattgaagcttcttattctgtgaatttctctattatttgatgktgatactctggagaagctgcagctagagatggagtacctctgccatctggatggttctggggaaagccactgggttctgttcacaactcatcagtggatt

SEQ ID NO: 1400 - DNA, 201 bp, Homo sapiens
aaatgtaaaagtaatcatttatttttggtttgattctaaaagtagtatattctctctatggaaaatatagaaaatacagaaacatgtgaaaaaatagtatycataatcccatcacccaaacccactcttgctaattcatgagagcaagaccttgtgtttcatgtctgctgtcacatcctcagtacttggaacagtgcctgg

SEQ ID NO: 1401 - DNA, 201 bp, Homo sapiens
agtaagtgcttaataaacatttgttgaatgaatgagtgttactgttttggtatacttatttccagcctttttgccctttttctatgtatattttacatgaytgtagtcagtcatcatcattagataatatctttttttaacttactatgataacacaggtatacctatgtcacaactctttacaaactttttttttttttt

SEQ ID NO: 1402 - DNA, 201 bp, Homo sapiens
acatatatatttgttgagtgccatcttctatatttgtctattaggtcaaattccacaataaccattaatttgcatgaatagtcaaatagagaagatatttrtctacccatttcccctatgaatagcttgttagctattttcccaatcttttttaactttatcaattccagctctcaattatttgctgaaagaagcatgtta

SEQ ID NO: 1403 - DNA, 201 bp, Homo sapiens
tttaaaactccagactatatcattattattctatagagtcaatattcatgtacattaatttaaatgtttacattttccattatttttcattccttcctgcwtttatgtgtttctcggtaagatcacttcctttctgcctgcagcaggctgcctctaatacaggtaggccctagaatgaaagtacacatgagatctacatgt

SEQ ID NO: 1404 - DNA, 201 bp, Homo sapiens
catccatcctgggagtgaggggccagggaaacagagctgcctgtcttcttgtcctgtagagtcagggttccccccacccccacctccaccctaaagtcatkcatggattattgagcaacaggtttggcccaaagaaattgccaggtttcaactcaggaggcaaagttcaggggctggaagtcacagggcagagagtaccca

SEQ ID NO: 1405 - DNA, 201 bp, Homo sapiens
aatgggcagagtcagaagaacccagacaatggggttcccaagtctaagctctcaccactaagccgtatttcccctctgcagggcggcttcctgtggcacayagctctggttctcattcatgaatagttaagcctgtctgcctaccccaaaattacattctgagttttgaagtctttgggctccgcccccttgcccaccacc

SEQ ID NO: 1406 - DNA, 201 bp, Homo sapiens
tttatgcacattcacactgttgaggagaaacagctgggacttcaagtctgatctttatgactctgaagcctgtgcgaaaaggcttttcactcctataatcyagtgacctgctttaccaacattgcctctaattcttaaaacaagcttagaaaggaatatgttgttagtcccattttatagtaggacactgaggcttggcaa

SEQ ID NO: 1407 - DNA, 201 bp, Homo sapiens
ccaaattctgcctgagacctggcttatgaggacttgtcctggaggcagcgtgttctgtgatgttaacctgggccctacttccttgataaaccttagtgagmcttttggctgctcatctacatcaggctcagcaaagcaggctcctagaaccaaggaagtccctccccaccataatcctacccacaccccactaaccacatt

SEQ ID NO: 1408 - DNA, 201 bp, Homo sapiens
catataaaaatgaatttgtaagatgtatacacactctaaaaaataaagatgccctatacaccggtgtgtcaattatcaagtttaagaaacaaaccttaccrttaactttgagattatttgaatgttcctacctgatgcctttccattctcactcctctctaaggtaaccacttaattttgggttattattctcttgctttt

SEQ ID NO: 1409 - DNA, 201 bp, Homo sapiens
tatttgaatgttcctacctgatgcctttccattctcactcctctctaaggtaaccacttaattttgggttattattctcttgcttttctttatactttatyatacctgtttgtatatctgaatgttttattatttagttccacttatttttgattagcatttacatggtgtctattttttatccttttattttcaacctat

SEQ ID NO: 1410 - DNA, 201 bp, Homo sapiens
gcagtggttcaatcacagctcactgcagccttgatctcccaggttcaagtgatcccccacctcagcctctgaagtagttgggactacaggtgcatgccacyacatccagctaatatttgtacgttttgtagaaacagggtttcgccatgttgcccagggtgcccccatctcagcctcacaaagcgctgggattagaggtgt

SEQ ID NO: 1411 - DNA, 201 bp, Homo sapiens
ttctgtgtttaaacaaaggggtgggggaagggttgaagtggcaagaaaagagaatattgtgttttgttctctttcctgaatgtaagcctgcccaagccaamctttttattttttctgagcatttgcctcccttaattaacagcaatcataaaaattgaagatttcaatgagtcaagactctcagctagtatatgatccctg

SEQ ID NO: 1412 - DNA, 201 bp, Homo sapiens
aacctccagcttctgggctctgcttgtttctcagaaaaactatggtacagcttttatttactttttggcctccaggtattccttacccatttgctattttrttgatacatttacatcccatgcaacctttctacttgtttttgtttttgtgtttctagagacagggtctctctctgttgactgggctgggatgcagtggtg

SEQ ID NO: 1413 - DNA, 201 bp, Homo sapiens
tgtcagtcatctttcactaaaatgcattttctccaagatcaacatccttgtctgtcttggtcacagctatgtgcacaatgtctaacaaagaacttgacatstaatagctgaaggattcattcaatttgtgtcgcattagtttactattaatgtaatctattcattcaatatttgtaattaaacaaatgaatgtatgtctat

SEQ ID NO: 1414 - DNA, 201 bp, Homo sapiens
ggatcctggttctgccttgcggcatctccgatatcagagagcagggagcaagcagctacctccacattcacagctgatgtgtctgctttcgtggacatgcrggaagcacagccttcagccccagactctttccaaatattaaatgctgaaagtagcaaacagtcttagaatttataataatgacaagaaacatttctaagg

SEQ ID NO: 1415 - DNA, 201 bp, Homo sapiens
tctatcctgttcaaaatatttctggggtttggtatgattagtaattttcaattgaatcctggacttttaaaaattgttatgaggccctggatcttattcaraccttccattttagctgcctttgacattattcttgcgagtgtggggaaggggccaccatttgttactgccaggtaaaggtagaagtccagcttccccatt

SEQ ID NO: 1416 - DNA, 201 bp, Homo sapiens
tctgtatttatttagatcatctttcatttctctcattagtgtctttgtagtttgtagcatacaagtcctatacatgttttgtcagatttatgcctaagtaytttgctttcttttgagtgattataaatggtatgcattttaatttgggtgtccaaatattcattgatagtagatagaaatacaattgatttttgtaagcta

SEQ ID NO: 1417 - DNA, 201 bp, Homo sapiens
ctgaaagaagcatgttaaagcctctcattattattgtagattggtctgtttctccttttagttctgtcaatttttgccttatatattttgaagctatactytatgtgcatagacctttataactttttatgttttcttggttgataaatgctcttacaatttcgaaatattcttttgactagtgctgatttttttctgaaa

SEQ ID NO: 1418 - DNA, 201 bp, Homo sapiens
tatttatctttaaaattatatttaacctcttaaattataagtaaaattatttcatgtttaatacttattccattttccctgttttattctctgctttcttrtctttttattgattatattttctcattccctttctcctcctctattgattctgtttctaattctatttctgtgattttttttctttctttcttttttttt

SEQ ID NO: 1419 - DNA, 201 bp, Homo sapiens
ttatttagatatacttatttatttgaggccctttgcttcttgataaatatttaaggataagcttaaatctaaaaaaaaaagacttgaaagtttgatactgyattaaatttgtagataaatttgggggagaattgacatctattaagcctaccactttaatagacatgatatattgctgcattattcaggccttatttaatg

SEQ ID NO: 1420 - DNA, 201 bp, Homo sapiens
ttgccttttgtgtttatgtttttagtctacctggaattgatgtctgtggggtataggggtacattattttttttccatacagttagcccattgttccagcrccctctgttgaaaagtgtctctttccccacagatctaaagtattagttttgtcagaattcaggtttcctcttatgaacatggggttgtttctaggctctc

SEQ ID NO: 1421 - DNA, 201 bp, Homo sapiens
ggtagggcaggatgttgtcttttagcacattttacagctactgcttggagccaggtcgagtcttctgtttatagaagctcaagacataccattcgaacctrgtcaatgtgttctgggtcagtggtttaaataaagcaaaacaaagcaaagaaaaactcaaacacaaaaatacccagagagagagagagagaaacaatgggc

SEQ ID NO: 1422 - DNA, 201 bp, Homo sapiens
cttttgtttccttattgtagtaagtagaacttccagtagtatgttgaatgagagtgttgagattgggcattctttctttgtccccagtcttggtgaaaacrtttagttttcattattaattatggttttagccacaggttttttgcagatgttctttatgaggttgaagatattctcctctagtcctagtgtactgacagc

SEQ ID NO: 1423 - DNA, 201 bp, Homo sapiens
agtggagcatccgccataaatcttttcctgatcctcctcttatcctgcacccttagtttccaccatccctgcttgaaacaacaaacaattaagaaacttayatattcccattgaagaatggcaactagctgcaggtaggaggaatttactgtaacaatttgtgtttccacccccagtttagaagaatgtctgaaaaaaggt

SEQ ID NO: 1424 - DNA, 201 bp, Homo sapiens
ggtctgtttatctaataaagccccacaggtgcctcaaaaaaaaaaccccaaaaaccaaacaaacaaaaaaaagagaatgatctgggcatagctcagagccrtgttcctcaaagtgtggtctggaccagcagaatcaatgtcaactgggaacttgttagaaatgtggaatctcagacgcccggacccagacctgctgaacga

SEQ ID NO: 1425 - DNA, 201 bp, Homo sapiens
gcagggagactgggattctggaggctgaggtcatgcctcagactgtttcttcactgatccggaaccctctgggcttccatttcctcactgatagaggaagragtaactccagcagggttcccaaaggacaaatgacgagccacctgcatcatctgcacaggctgacaaacatacaggtttccccagacccgaaacgtgcag

SEQ ID NO: 1426 - DNA, 201 bp, Homo sapiens
gcatagtacataatagatgctcagtgaatttcatctctctcttcccttcctttccttgagtcaatgtgtttttcattcccaaactgggagtgtggtgtccyagtgttagaagaaggtggcttccctggtgccaccctgagctgagaactttcccagtccctggttttctgcacatctggggtcatacaggagtacactgga

SEQ ID NO: 1427 - DNA, 201 bp, Homo sapiens
gagtctaaaggcctgagaaccaggagagccaatggtgtggttcccatccaaaggccagcaggctcaagcccaggaagggctgatttttcagttggaatatraagacaggaaaaaggctgatgtcctagttcaaaggcagtcacgcacgaaggatgctttctaactcaggggaggtctgtcttttctctattcaggacttca

SEQ ID NO: 1428 - DNA, 201 bp, Homo sapiens
gataaggagtcataggctccaagaaagttagacattactagctcaatgatgggaaaacccatttctgtcctaataataaagggcattttgcagaaaacacrgtgaaggatgatgctgaagtgcccgtttgcatatattgacagcaagaccagtgtcaagtatcataaataaattgccagagagaaagtaggaagtttccat

SEQ ID NO: 1429 - DNA, 201 bp, Homo sapiens
gcttgttccatgtacatgcattgtggtgagctggctgggatatgactgaatgtgtgcctgagagacaggggccttgtgggggaaaaggaaaatgttcaaartaaggtcagatcatgaggatggaagggagattaaaagctaattcctttggttctgattcttcaaagaaaggttggtcaattatacccatatcttcataca

SEQ ID NO: 1430 - DNA, 201 bp, Homo sapiens
gatctgaatttgtacctcaacttggatacatcatattggctgtgtggctatgggctggttactctacctctccaagcctggctttttcactagtaaattcrtatgataatcataatatctttgaacatgctcatgtgtgtgcatcctataacccactaagtaaatatccagtaagtacccagtaaattattatcatcatct

SEQ ID NO: 1431 - DNA, 201 bp, Homo sapiens
cctggcctctctctgtatgtttttgctgagtgatattatgttaattttaactgctacttatatgtgagtgtcttttgaatctgtattattagcttccaatyctggatttttagtatccccgtaccaaaaacacttcatctgggtatcccacagtagcctttaagtcagaacattagaaatcaaactcatcagctcttccca

SEQ ID NO: 1432 - DNA, 201 bp, Homo sapiens
agataaagaaaagcaaggtgcagagaaatgtatttactagctctggtcacagttggctttggttagaacttaggcctgtgcaacctcaaagttcatcttcyctccacccctgcacaatcttttcctctgatcaaagtgctaatgaagcagtcttaaaactttattaacacatttgacaagaatcttttgccctcctgtttt

SEQ ID NO: 1433 - DNA, 201 bp, Homo sapiens; identical to SEQ ID NO: 1168

SEQ ID NO: 1434 - DNA, 201 bp, Homo sapiens; identical to SEQ ID NO: 826

SEQ ID NO: 1435 - DNA, 201 bp, Homo sapiens; identical to SEQ ID NO: 828

SEQ ID NO: 1436 - DNA, 201 bp, Homo sapiens
aatacctaaagtttaggggtagagttttccctcatttgaaatatcctgctggttgctcctttaatgcaaagataaagggatagtaggggacatgttataartacattgtgtaatttcagagaaaatctgatgtaattcagctcatgtttagagatgtctgcaaaaacttgcataatctcatttcactgaacctgaaaacca

SEQ ID NO: 1437 - DNA, 201 bp, Homo sapiens
atagtaaccccagaaggcaatgtacaaccaggtgtgggaccgctaactagagttttccaagagtgttccttgagacaaagtctgatactcgccccaaaagygctgcaagcacaaagaagtttgagaagcactgcatattgtatttacttcagaggtttatagtgtaactcaacatattataggattttggaagttcttcag

SEQ ID NO: 1438 - DNA, 201 bp, Homo sapiens
caagcatgtatcctttgagttccacctaacaattggttacattttcttctttaatagggaaaaacagattttttgggtatccatcccaatctgacccacamgatgagtgactgttcatcctccttcatgctgttatcatgggccaagtaaaggggctgaatgtaccagattctaattatataaactgaaacgttagtcttc

SEQ ID NO: 1439 - DNA, 201 bp, Homo sapiens
cagctttccttaagctgggcttttcatcagagaggaaagagtgccaaaggtgcactgttgcttgtgctttcttgccaaagctcccagataaactcacaagsttcagttgcctgaagagagtcaagctgcatctgttttgcccatcatcctcaaacaagtcttgcaagtacacacctctgggaaagaggcaaatggtgacaa

SEQ ID NO: 1440 - DNA, 201 bp, Homo sapiens
atattttgggttaggagaagaagctaattaggtaggcagatttagaagggctgctggaatgcgggacaaagcgaggtgatttgatgcaattcactgttttyggtttttgttttttttttttctaagcagtaagttgtgttcaaagtcacagaaaattggcttgaaaactgaggtgacaaggaacaggagggcatccctgtg

SEQ ID NO: 1441 - DNA, 201 bp, Homo sapiens
ttcacatagccattatggggagcttgtaagtcagcacaaaacgaaggcttagggcagcatcggcatagtgctgcgtaagtgcttgctagcatgattatcaytattttagggtttgatgttttgggcagttgcagagactcatcttctgtgccatgagataatagctcccttttcccactaggacatcccttaagattagga

SEQ ID NO: 1442 - DNA, 201 bp, Homo sapiens
ggtcactcaattgaagggtgtagaagtaaggtcaggttcaccttagtgaggggcctgcatctaaccttatctgaaggggcttatgaatttgggatttattrccttgacagaaagaaatattgagaatgaccccacccatgctttatagcaatcgctctttatagtttatttcatagtgacaagaaggaactcatccatggt

SEQ ID NO: 1443 - DNA, 201 bp, Homo sapiens
aaagtcatttttgcagtgtttgtgttctatgaagagtgggtagaaggaagcaggagagtattcctgcctccccaggagagagcttcactttctccctataycttcctgtcctaccagcccacctggttctctgtctctctccaactgtgaccgtcttttccttgtagctccctgctcactccatgtggaggatggctcttg

SEQ ID NO: 1444 - DNA, 201 bp, Homo sapiens
cattcatatcttcttgccatccctgtctcatgggtgagcacatttcctggatttaaaatgtatgggacagcctgtgagaattacagattccagggaagggscccttttggcacggggggtctgatggtcagagctaatcaggtgtggaagaagctgcctggagaggatccccatctgcatggaatgcccccttcgtgggga

SEQ ID NO: 1445 - DNA, 201 bp, Homo sapiens
ggtgcttggccctcccaggtgcctggttgtggcctgccacttagcacccacccctgcctatccagccccatccctggggaaggttcccacctgctccaacytctggtactcccaggctgcctcacccaacgatgacagtgactagcctcagagcctggctgcttggaagacctttgcccaagcagagaactgttgaggaag

SEQ ID NO: 1446 - DNA, 201 bp, Homo sapiens
ggttttgggtcaccttgttttatggtccctgtcccagcatgaagcttgcacaggaagaacagaatgaatgatgtggaaatctgttagcagtggtgtcttcbagattctcaaggatccgggtattttaggaacaaaacaagccagcaggtgcagaggtcacaagcctcctgagagggccagggcagagtgagtagctgcagg

SEQ ID NO: 1447 - DNA, 201 bp, Homo sapiens
gtctcatgggtgagcacatttcctggatttaaaatgtatgggacagcctgtgagaattacagattccagggaaggggcccttttggcacggggggtctgayggtcagagctaatcaggtgtggaagaagctgcctggagaggatccccatctgcatggaatgcccccttcgtggggatggctggcacagctcacacacgga

SEQ ID NO: 1448 - DNA, 201 bp, Homo sapiens
ctggccccacactcactgctacatctctcttccaaatcataaatgcaaaagatggccaaaggtgcatgctctgtgacacgtttcatagtcagacaaaaccrgctgactgcttttacttttttttttttttcatttagaagaatttccttggcaactccgtctctccttagtcaacatcagctaacttcatcctcccccttt

SEQ ID NO: 1449 - DNA, 201 bp, Homo sapiens
gcagcctgcaactctgaggctcaagtgatcttcccaccacagcctcctgagtagctgagactacagtcatgtgccaccacacccagctaattttttttttyccaaagagatgggatcttgctacattgcccaggtgggtctcgaactcctggcctcaagcaatcctcttgccatggcctcccaaagcactgggattacagg

SEQ ID NO: 1450 - DNA, 201 bp, Homo sapiens; identical to SEQ ID NO: 166

SEQ ID NO: 1451 - DNA, 201 bp, Homo sapiens; identical to SEQ ID NO: 902

SEQ ID NO: 1452 - DNA, 201 bp, Homo sapiens; identical to SEQ ID NO: 905

SEQ ID NO: 1453 - DNA, 201 bp, Homo sapiens; identical to SEQ ID NO: 906

SEQ ID NO: 1454 - DNA, 201 bp, Homo sapiens; identical to SEQ ID NO: 910

SEQ ID NO: 1455 - DNA, 201 bp, Homo sapiens; identical to SEQ ID NO: 911

SEQ ID NO: 1456 - DNA, 201 bp, Homo sapiens; identical to SEQ ID NO: 912

SEQ ID NO: 1457 - DNA, 201 bp, Homo sapiens; identical to SEQ ID NO: 915

SEQ ID NO: 1458 - DNA, 201 bp, Homo sapiens; identical to SEQ ID NO: 916

SEQ ID NO: 1459 - DNA, 201 bp, Homo sapiens; identical to SEQ ID NO: 918

SEQ ID NO: 1460 - DNA, 201 bp, Homo sapiens; identical to SEQ ID NO: 919

SEQ ID NO: 1461 - DNA, 201 bp, Homo sapiens; identical to SEQ ID NO: 921

SEQ ID NO: 1462 - DNA, 201 bp, Homo sapiens
cgtgagctctcccgttcagcttttttgctgatcatgtgtaacatttccgtcatcctgagtagagaatacacccttgaaatccatcccacctgctccccttwctggactggctcacacccagtccctgtggcccctcaggcctgggctccctgtgttcagggccagtccccgggcaggcggccctcacccgttctatcctcc

SEQ ID NO: 1463 - DNA, 201 bp, Homo sapiens
ccataagagagatgcagagagagaaatttctttatgtgggttaatagcatcatctttatcctttgttaaaagttaaaaagcataacagatggataatagasgtcagtgatttcaaatcctgaaaagaacctgctagtcagagaggttcactcagcactcggaaattgatgaatgaagtaatcattctagcagcaattgtct

SEQ ID NO: 1464 - DNA, 201 bp, Homo sapiens; identical to SEQ ID NO: 753

SEQ ID NO: 1465 - DNA, 201 bp, Homo sapiens; identical to SEQ ID NO: 754

SEQ ID NO: 1466 - DNA, 201 bp, Homo sapiens; identical to SEQ ID NO: 755

SEQ ID NO: 1467 - DNA, 201 bp, Homo sapiens
gctagtgggcccccgcctgccaacccagctgctgttctaggaaagcaaccccggggtacactacgagcacaccatccacagggaggcaggtggccacagcraggtcccgctgcccaagttctcctggcactgtgggccctggaccaagtgcacagtcacctgcggcagaggtgagaagtggggcaggcacagccccaccag

SEQ ID NO: 1468 - DNA, 201 bp, Homo sapiens
tggtcaccttggctttcttctccgcagctctgggcagggccaggggcctgtcactggtcgggggacttaggagaccacgcaaacacccactccaccctggrtctccaagctgccaggccccctctgaaatctgggcttcgggattccatggtctgatccaccctcccagcccctctccacacctgccttcagtagtcttgg

SEQ ID NO: 1469 - DNA, 201 bp, Homo sapiens; identical to SEQ ID NO: 1144

SEQ ID NO: 1470 - DNA, 201 bp, Homo sapiens; identical to SEQ ID NO: 1145

SEQ ID NO: 1471 - DNA, 201 bp, Homo sapiens; identical to SEQ ID NO: 1149

SEQ ID NO: 1472 - DNA, 201 bp, Homo sapiens; identical to SEQ ID NO: 1150

SEQ ID NO: 1473 - DNA, 201 bp, Homo sapiens; identical to SEQ ID NO: 1151

SEQ ID NO: 1474 - DNA, 201 bp, Homo sapiens; identical to SEQ ID NO: 1154

SEQ ID NO: 1475 - DNA, 201 bp, Homo sapiens; identical to SEQ ID NO: 1155

SEQ ID NO: 1476 - DNA, 201 bp, Homo sapiens
cagcattgaccttcagcatggccttctcacagcatgctctggccttctccacctctgggcctcttttcacactgccccgcctctttaaatgtcctttcctyccatcccagctctgctttctctactattttctctttttttcaaagctattttaaacattgttgcctccaaggagtctttcctgatctctctgctggaaaa

SEQ ID NO: 1477 - DNA, 201 bp, Homo sapiens
ggcattttaaaaggtccatcacattagcttcttagacaagatggagaaatgagaacttcattgtttattagagagaagagctgacatcaacatctggctcytccagaaactagctaaatagcattagagaggttaggggcaattccctttttatatgcgtaatgcatttctgacttcaaaatttttttacaaagcctgagt

SEQ ID NO: 1478 - DNA, 201 bp, Homo sapiens
gaccctcactccacacttctgcctctttcttctgtttataagggcccctgtggttatactggccctaactggataatccagaataacctcccctttcaagrtgtgccaattagcaatcttaatttcatctgcaaccttagttcttctttaccacataacctaatacattcacagattccagggattaggatgcagacatct

SEQ ID NO: 1479 - DNA, 201 bp, Homo sapiens
ctatttcccagttccaaagcagatttctacaatattaggaatttctaatgggcggcaccaccccttataccaacttctatcctaatcagttcaggctgctmtaggaaattagcatagattgggtggttttataaataaaagaaatttatttccaattctggaagtaggaaatccaagatcagggtgccagcatggtcaagt

SEQ ID NO: 1480 - DNA, 201 bp, Homo sapiens
gtcctatcttctctgtttcctttagtcctatctggcagtactcccactggcataatcccatctctattcttgtcttttgttgagatgactgattaagcctrtcattcacattcatactaatcttatcaaatggacacttggccacagccttcgtgttctcttccaaatacactttctcacttttgcaatacggataggcta

SEQ ID NO: 1481 - DNA, 201 bp, Homo sapiens
caccaatctagctgccatcccagatgtgcaattgttactggaacaaacagcctctagaagtattcactggcactaatttggaaatgtgttcttttccacayttatcaggaagcaagttcagaagcaacgtacattctcctagcatagccatccccaaacattcccccaaattcccagggctagctgaactctcctcagcca

SEQ ID NO: 1482 - DNA, 201 bp, Homo sapiens
gtgtctacataaaaatcaaacttttcttcacagcaaaagtaagcaaagtaaaaaaattaatattgagatataaataaactaaatatcaactcatataaagragggtacttaactcaatatcaattttaaaacaaaatactttttcagatggcaacgtatataacagataattcacataaaataaaaaattaattattctga

SEQ ID NO: 1483 - DNA, 201 bp, Homo sapiens
ctctgagactctttcctccaattagtctattctgctattaatacttgttattgcattatgaagttctcaagctgtgcttttcagctccatcaggtcagttrtgttcctctctaaactggctattccggttatcacctcctgtattgttttattgggttcttagtttctttgcattgggttacagcatgctcctttagctca

SEQ ID NO: 1484 - DNA, 201 bp, Homo sapiens; identical to SEQ ID NO: 1188

SEQ ID NO: 1485 - DNA, 201 bp, Homo sapiens; identical to SEQ ID NO: 1189

SEQ ID NO: 1486 - DNA, 201 bp, Homo sapiens; identical to SEQ ID NO: 1190

SEQ ID NO: 1487 - DNA, 201 bp, Homo sapiens; identical to SEQ ID NO: 1191

SEQ ID NO: 1488 - DNA, 201 bp, Homo sapiens; identical to SEQ ID NO: 1192

SEQ ID NO: 1489 - DNA, 201 bp, Homo sapiens; identical to SEQ ID NO: 1193

SEQ ID NO: 1490 - DNA, 201 bp, Homo sapiens; identical to SEQ ID NO: 1194

SEQ ID NO: 1491 - DNA, 201 bp, Homo sapiens; identical to SEQ ID NO: 1195

SEQ ID NO: 1492 - DNA, 201 bp, Homo sapiens; identical to SEQ ID NO: 1196

SEQ ID NO: 1493 - DNA, 201 bp, Homo sapiens; identical to SEQ ID NO: 1197

SEQ ID NO: 1494 - DNA, 201 bp, Homo sapiens; identical to SEQ ID NO: 1198

SEQ ID NO: 1495 - DNA, 201 bp, Homo sapiens; identical to SEQ ID NO: 1199

SEQ ID NO: 1496 - DNA, 201 bp, Homo sapiens; identical to SEQ ID NO: 1200

SEQ ID NO: 1497 - DNA, 201 bp, Homo sapiens; identical to SEQ ID NO: 1201

SEQ ID NO: 1498 - DNA, 201 bp, Homo sapiens
agtttgaaggaccataaaagagagataagttggctatgagagggcagtaagaaactccagcagtgctataaaacaccacatataagtctttatggcagtgycactgtattttccaattagaaataacagttattataaattacattttttcacagccccaagtatttacttaacgcacccaaaaaaataaattaaaattct

SEQ ID NO: 1499 - DNA, 201 bp, Homo sapiens
ataatattgtgacagtaatacatgtgcccaactgttaacacatcaagcaagatctagtagcatgtctaagagctactgttatcttgaagaagtgatgaacrtaagtaaaactttgacatctacggcaactcgagtgggatccctcgaccaaagttactgggatcaggtaactttggtccaagtgtgggtatgacagaagat

SEQ ID NO: 1500 - DNA, 201 bp, Homo sapiens
ataaggcatgccagttctacaaggaagttttgggggaaaacactgaagtagttttatcctatttttttgttttgtttctgtttctttgttttttaaattgytttaatgattttccaaaatggagctgctggaggtcctgaaattgcataactctgcttactctcctctctgttgactttatttcacttacctgctagtcac

SEQ ID NO: 1501 - DNA, 201 bp, Homo sapiens
tctctgtgtgcataccaagaaaaggccctgtgaggacttactaagaagcaggcagcctgcaagccagaaagagcctgaccaaaagctgactcaattggcamcttgatcttggacatcccagcctctagagatacgagaaataaatgtctgttgtttaagccactcagtctgtgatattttgttatagcagcctgagaagac

SEQ ID NO: 1502 - DNA, 201 bp, Homo sapiens
tgggttatttcattgtagcattttctgaagggatttttaagggtaatttcatctgtatatgactgctattgacttaactgtgtcctctccaaattcataaytgaagtctgaattccagcatgactatatttagagatagggtctttgggaggtaattaagtttaaatgaggtcctagggtgtgggcctaatctgatagaat

SEQ ID NO: 1503 - DNA, 201 bp, Homo sapiens
ttagagatagggtctttgggaggtaattaagtttaaatgaggtcctagggtgtgggcctaatctgatagaattgctggtcttgtaagaggaaaacagcctstctttctctgtgtgcataccaagaaaaggccctgtgaggacttactaagaagcaggcagcctgcaagccagaaagagcctgaccaaaagctgactcaatt

SEQ ID NO: 1504 - DNA, 201 bp, Homo sapiens
catctgatgctgaccctaaggaatgataatctgttccagcgctgaagaaatgcctggctatgttgggttatttcattgtagcattttctgaagggattttyaagggtaatttcatctgtatatgactgctattgacttaactgtgtcctctccaaattcataattgaagtctgaattccagcatgactatatttagagata

SEQ ID NO: 1505 - DNA, 201 bp, Homo sapiens
aatctgttccagcgctgaagaaatgcctggctatgttgggttatttcattgtagcattttctgaagggatttttaagggtaatttcatctgtatatgactkctattgacttaactgtgtcctctccaaattcataattgaagtctgaattccagcatgactatatttagagatagggtctttgggaggtaattaagtttaa

SEQ ID NO: 1506 - DNA, 201 bp, Homo sapiens
tgatatctatggaccatttctcagaatgttatttttaattttataaaataaaacctgtaagctgagaaaggaaaccaattatactgaaatacgcttatcawaatattgtgacagtaatacatgtgcccaactgttaacacatcaagcaagatctagtagcatgtctaagagctactgttatcttgaagaagtgatgaacat

SEQ ID NO: 1507 - DNA, 201 bp, Homo sapiens
aaaataaattaaaattctccaaaataatggcagtagaaattatggcagcaaatgcaaagactgaaaagttaagataaacaaaattaaattcaccactgagsctttaatgtgtttattttgtatacatatgtatctgcttatgaattctatttatgaatatatgcattttaaaatagctgttatttacttttcctgagaacc

SEQ ID NO: 1508 - DNA, 201 bp, Homo sapiens
tacttttgttataattcatgagccaatattgacaaagttcacaatttattttagggttagttctttgtctattacattctattctatggcttttggcaaaygtataatggcatatatccactgctgaagtatcatatagaatactttcactgctttattattatttttcaatatgtaaaaatatatgtatttatttactgg

SEQ ID NO: 1509 - DNA, 201 bp, Homo sapiens
tgtgtcctctccaaattcataattgaagtctgaattccagcatgactatatttagagatagggtctttgggaggtaattaagtttaaatgaggtcctaggrtgtgggcctaatctgatagaattgctggtcttgtaagaggaaaacagcctgtctttctctgtgtgcataccaagaaaaggccctgtgaggacttactaag

SEQ ID NO: 1510 - DNA, 201 bp, Homo sapiens
gcagttgaaccctgttgatgctctattttgcaacgaaagcatgtgtaggcaacagactctcaaaagtttgaatatttgacctgatgagtttgaaggcagargggatccgtttccattagagcagcagttctcaaagttaagttcctggaccagcagcatcagcatctgggaacttgttaaaaatgcaaattcttgggtccc

SEQ ID NO: 1511 - DNA, 201 bp, Homo sapiens
ttagcaacttgtctatccaatcatatcctttttttaattaaaaaagttctatataataggattttgtaatctgtttttttcactaaatactgtcatctcartagagcttatttttacatgattttgaaatatgcctgcatggtattcttctataggaatgtattgtaatttatttaattagtcctctaagggatgggcatt

SEQ ID NO: 1512 - DNA, 201 bp, Homo sapiens
tttcttccacctattactgcccttacaccctacagtcttatttccttgtgctcattataactaagcataatttacaattctctaactgggaaaaaacctgratactttaagtaatacaagcaatgtataccatggaagacaatgtacaattataaacaaatgaatagtgatattgccaagtgataaaatttaatatgaaaa

SEQ ID NO: 1513 - DNA, 201 bp, Homo sapiens
cttctcctgccaaaatcaaataaaaagaaacaagagttacttgcttggcagtaactccttttcctgcccaactaagcttgaatgacggtataaaggagtcrtgaaatggtcagaagttgtggggagcaagggaaaggaggaaaagcaaatgatctatataatctttggacaacatggcttggaatgactgaccttgagatg

SEQ ID NO: 1514 - DNA, 201 bp, Homo sapiens
gttttccagaatccattcattgattcattcattgattcaatcattagacaaaacacataaaccaagttcatgttaagcaatcactaaatgacagctattaytattatcaccaagaactaacagcctgaagggaaagatagatacataaatgaaatacatattttttaagtggaataacagaaggaagtatgttagtagctt

SEQ ID NO: 1515 - DNA, 201 bp, Homo sapiens
aaataatcaaatgatgactcaaggggcaactttctattggagaaatatcttcttccaaggtaatttcagggtaattttctgaaaagatgttcaagaatgartgaggaaaatctcagtttctaattttgccaccacatgaccatttttctctttttgataaattactttcatctctgtgcattgttttattttttgattttc

SEQ ID NO: 1516 - DNA, 201 bp, Homo sapiens
cactttttctgagcctgtattgcctctgcaaaacattatagcagttacttagagggaaggatttttttctagcctcctggtaacaggctccattcagaackttctcgacatcttatatcaatacttcctacatctacaagccccagaaatctctatgttctacttgttaatgtctatttagagctgaggcacagcgtagaa

SEQ ID NO: 1517 - DNA, 201 bp, Homo sapiens
cttgtaaaaacacttgacgagctagcctacatagttgtatttcacaaagccatgtgaacattaattactcagggcatctgatggctcgaccacagagtgcrtgtgatggacacattcaagtcctgctttgcacaatgcccagctggcactggcaacagctgtagttcacatgactgtctcctgatgtgcacaggtggtatg

SEQ ID NO: 1518 - DNA, 201 bp, Homo sapiens
ctcacccaaagtcacacagctggttaagggcaaggggagggctagacccacatctcctgacttttaattcactcactaaaccacatgcttctccagtaccrtacacttagccacaaactctttgaagagattgaataattcaaacagatgacgcccttgtagaaggacaaagtgcggggcagcctcacttctatgtaaacc

SEQ ID NO: 1519 - DNA, 201 bp, Homo sapiens
agctatcccaccaaggtcccagtgcaaagatgtccctcccaggcgcctggtggggagctgggaggttaggctaggtaagagctaggaagccgtgcagaatkgtgaactggacatgcgctttgggtggagacagaacaggtttccactccactacttaatagctgggcaagttccttaacctctctgatcctctgaaaaatg

SEQ ID NO: 1520 - DNA, 201 bp, Homo sapiens
acagaaaaacatttgaagctgtctgaatgtcttagacgatcagaaaaatttttgttcatgcgtatagtgaaatactatgcaactattaaaaattatgtcaygatctatatttgtcgacatgggagggtgtttatgatatatatagtatacttatatagagagtgtacattttaaaatcatgtatattccaggattttttct

SEQ ID NO: 1521 - DNA, 201 bp, Homo sapiens
tcaccagaaagaccaaccacgtaattagagggttggggttttgaaccagccctgcctccaaggagggaaggacagctggagattgagttccaccacatggycaatgttcagtcatgccaatggaatggcactctgataaaaactctggatgttgaagctcagtggatctcctggttaatgaacacactgatgcactgggag

SEQ ID NO: 1522 - DNA, 201 bp, Homo sapiens
aaaaaattttgcacactgtgggtagcaatgcaaaattgtgtgactatgagatgtgctttcaggttagacatcaccaagcagtgcactagtagattctggaygaattatggtgtctagcttccaaagtaaccttttatttataaataaataaaaaaagtgcatagggactgttaatcttcatgagggacgcttagcatacta

SEQ ID NO: 1523 - DNA, 201 bp, Homo sapiens
tgtcttcctcagtgggtgtgctctctcttcatggcaaaatcctcaaggtcagggctacaaatgggactcctcctgtacaaccccagacaggcagcccatayaagcacaaaggagatgcctacctattaattatgtccttactgaattgaaatgcaatgcttctatccatcacattagtttggtagacctttggatttgaaa

SEQ ID NO: 1524 - DNA, 201 bp, Homo sapiens
ttgaagaggaaacacacaagtaggcaaataaattctagcacagtgggaggctgtgacagcaggaggatgggaaatgggcagaagaagccaatcgccaatcrccacagtttcacaggggctggttctgacagccacgtctcagacccggaggatcctggagggactgcattgattaatgggctccttcactttctggctttg

SEQ ID NO: 1525 - DNA, 201 bp, Homo sapiens
ccagggtctcctcaggtatacctctgcctgaccccgcttagctctggaaatcagagcctgtaatgatgagaagtttctgtggggataactgcctgccgacrtatatggaaagcgctcgttggggagaaaattcaccttgacttgcactgttgacatgcaatcactttcctgttgttggggtagtactcatcgcctgtcctt

SEQ ID NO: 1526 - DNA, 201 bp, Homo sapiens
tgggctgtgattttgcatgtaaaacattaggcattgtcattgactttaccatctgcctccttaaacatgacagtccctggaaggagaatacgaatacctgratgtggaagggcatgtgacagtataaggagtaactgcccattgtgatgacaaaaggagtttttcaggtatttcatggcactaactggaaatatcaataag

SEQ ID NO: 1527 - DNA, 201 bp, Homo sapiens
cacattagcaaggtgactgggaacaagttgcaacttagtttctgagcctcagatttaggagagtaatagccatgtagccttgctgtggggattaaattacrtactgtgaagccatcttttagaagctatggcacttaataggtgatcagtaactattagtttctgtgctttgcaataagttgcacatctagatttggtgat

SEQ ID NO: 1528 - DNA, 201 bp, Homo sapiens
gtctaactggcttgtcacgtctctgccaagatggcagtattgcgggtggcatgttttcagtgcactaaccaacaccccaacgcctgtcaggagagaacaamctgcaagtaatcggagatattatgtattagtataggaattgttctccagtttttcaagatgctgatcagaaagataacgattcaaggattcacggcagtg

SEQ ID NO: 1529 - DNA, 201 bp, Homo sapiens
cagacacagaaatatgttaacttaataatgtggcaaatgtactattaatctttagtgaagcaatattaatatattgcctaatcttagaaaaggctgcagtktcttgaaagcttgaaatcatttctgcctctgcctgaagttctgaaatcatcgccctgtaaaattttaaatacttttatttcatccaagcctttgagtatt

SEQ ID NO: 1530 - DNA, 201 bp, Homo sapiens
aatgtactattaatctttagtgaagcaatattaatatattgcctaatcttagaaaaggctgcagtgtcttgaaagcttgaaatcatttctgcctctgcctsaagttctgaaatcatcgccctgtaaaattttaaatacttttatttcatccaagcctttgagtattcagaaataattgctgtcaatagagattcattctca

SEQ ID NO: 1531 - DNA, 201 bp, Homo sapiens
ttagtgaagcaatattaatatattgcctaatcttagaaaaggctgcagtgtcttgaaagcttgaaatcatttctgcctctgcctgaagttctgaaatcatygccctgtaaaattttaaatacttttatttcatccaagcctttgagtattcagaaataattgctgtcaatagagattcattctcacctttgactggccagt

SEQ ID NO: 1532 - DNA, 201 bp, Homo sapiens
ggtggctctgtcttgtttaaaagagccatgatgattagatcatattcatatggagactaacagacagctagaaattcaaacattggggtttgggggagagrttggatctggaagcaacaatattagggtaataaagataactgtggacagtaatatacattagatagttaagacagaacaagtggagaatcaaaaggaggc

SEQ ID NO: 1533 - DNA, 201 bp, Homo sapiens
ttatcttgtaaaatgtttgttttgggttctcagacctctgtttgcaaatgaaagatgctccagtcataacagcttaaggagaaagggtgatttaccggcasatgtaaacaaaccaagagagagcattgcactagccttggagtaagatggattccagtctaaagtaccatcaggaaacactgtgtcactcatctctgcttc

SEQ ID NO: 1534 - DNA, 201 bp, Homo sapiens
agggagtaaatgtggggaaggagaatgctccagctggcagctcctacgaaaagcacagagctggattaggagaaatccactttcttaaaggaatatctcaytactggaaaggagtgataggcaaaaccaatatctcctagccaggcatggtgatgcatccctgtaatcccagctacttgggaggctgaggcatgagaattg

SEQ ID NO: 1535 - DNA, 201 bp, Homo sapiens
ttaacttggaataatgcaagccattcagcaatatgatacgaatagatatttccttttcaaaacattgcacaaatacatgatttcctccctctttccacccrgtaggagaagtaggaaaagagcacggtaataggaatttacctccaagctataaagccttcctatcctttcagtaatcaccaaagagagttcctagttact

SEQ ID NO: 1536 - DNA, 201 bp, Homo sapiens
gaactttgaatagaacttggcaaacaaaggaaggaggagccctcagtcacagactgaacttgtattattatacagttgacccttgaacaacataggtttgmattgtgctggtccacttatacccagatttccttctgcctctgccacccctgagatgacaagaccacccctcctcttcctcgtcctcctcagatgctgagg

SEQ ID NO: 1537 - DNA, 201 bp, Homo sapiens
ttgcaatcaaggaacattaattcacacccaactccaggtaacagagcttccacagtctacaaggaaatctcagagaaggaatttgatttccctgctcataycactttctaactccttagatcaattactgcggccaaggcaatgggatattatcctggaccacacctgagtcatgtgccagatgtgaagggctagggagtg

SEQ ID NO: 1538 - DNA, 201 bp, Homo sapiens
aagcagaacatctattgtcaaatgccacttctgtatctaataactatttatttatcctacagagggaaaaaactgagactttcctccaactataggcaaaytcttcccttatagtgagtcaggttgtttgttgaattactgggatttcattttctttttattataaatcccaaaccttgggtttcaggagtaactaaaata

SEQ ID NO: 1539 - DNA, 201 bp, Homo sapiens
tgtcattccctcataatacttgtcacagttggcaactgactgcatctgtgtgattattttaagtctgtttccataactagactctaaataccataaagccrgagactatgattgtcttgcttatcccagtattccctgggttgctaagtttgtctgcgataaacaaataatggcttcatacatcgctgcatgaggcattta

SEQ ID NO: 1540 - DNA, 201 bp, Homo sapiens
atctccatctcacgtttcggggtcccaggttgtcccaaccagagcctcggctgagccctctgttgtctttgaagcttagcaaccctgactataaaactctsagtttgctcctcactgcagctattctcccataacaggagggagagacactttgtaagctactaaagatgcctggtggtcctcacacttagttcttaactg

SEQ ID NO: 1541 - DNA, 201 bp, Homo sapiens
agtattggctgttatgtgaaacacacagtcacatttacacactctgaggggtcaggatagccttcagagccacaaacttctgtggcattcacccagatatytccatctcacgtttcggggtcccaggttgtcccaaccagagcctcggctgagccctctgttgtctttgaagcttagcaaccctgactataaaactctgag

SEQ ID NO: 1542 - DNA, 201 bp, Homo sapiens
tctgttttgcgtttttggggggagtgaacagggggagcttcttttcaataaagcgaaagaaatgctctaatacagaggagaaaagaggaccaaacagggaycattctctatacagacatttgtctgaggagagaaaggtgttcaagaaaagcagtggaaaggttaagggaccatccaaagagagatccaagccctgctctg

SEQ ID NO: 1543 - DNA, 201 bp, Homo sapiens
gttcatgcaggcatgagtggagcctccaataatgtcaactgctcccaaatcatatagcctgagaacagaaaaggggagatgaccaaacaaaaaatagctgwtcattacaaatacaaatgttaaaagcttggtctgaagtccaattttaggtgaccaaaatttgagccaataatttttaaaaagaaataaaatccaaagaaa

SEQ ID NO: 1544 - DNA, 201 bp, Homo sapiens
aagttcacttcttccccttgctactatgcaagaatagaagatcaataaaaagaagaaatcaattaaattttgaggtattccatactagatttagataaacrtgttcttcaaaatgggttgcatttaggaagaaaacagacttttcctatttttaacatgtttgctactttttaacttgctacctaatttgcagtcttttgt

SEQ ID NO: 1545 - DNA, 201 bp, Homo sapiens
gcaatcctctcacttctgtctcctcagtagctgggactacaggcagcacaccaccatgcccagataattgtttttgggcttttttaagttctttactcacwtatctcccacctctcaccaaattttttttttcggatggaattttgctctgtcgcccaggctggagtgctgtggtgcaatctgggctcactgcaacctctg

SEQ ID NO: 1546 - DNA, 201 bp, Homo sapiens
agccgagattgcgccactgcactccagccttgacaacaaagtgagactctggctcaaacaaacaaaaaaaaaagtcaggacatctcttgacataaattctsacgtataaatttacattcatactcaaagatatttgaaatcaggaccatgctcctgaatactagatctagtatcactatacttctaattcatataggattg

SEQ ID NO: 1547 - DNA, 201 bp, Homo sapiens
gtatcactatacttctaattcatataggattgcaggagaaaatggaaatgccacgtttatttaactgttctcatttatggatgttaaccactaagtgtcaygtagtcatagaagcaaaagttagaattgaacatactaatttttaatagaatgtacttaactccacaaatctaagacactgtcaaagaaattgagggaaat

SEQ ID NO: 1548 - DNA, 201 bp, Homo sapiens
acaaatgctaggtcttattgcccatagtcctgggattagtaaaacagaacaaggacacccactgcagtccaagtgtgttctcactatacctttagagatcyccagtccgtagacctcttccaaaaagaggggaaggggaggagttattacactcttctataaacacgtaggcttttgataatctggaaatatcaaatgagc

SEQ ID NO: 1549 - DNA, 201 bp, Homo sapiens
ggagtatattataacctggaagagctgagcccttcagatttgtcctctgagttcccaaagtgcattactttctctcaggggaaagattcatcaatgtgcaycagatggggttgaagggaatgactgatgttcaacattttgtgtgggtgttgatttgcaaacaaggagtgattttttaaactagcatctgtgtttgccaat

SEQ ID NO: 1550 - DNA, 201 bp, Homo sapiens
aacaaacaaacaaacaaaaaacaaacaaaaaaaacatctggagtgagaattctccctctcaacccttccctcagccccatagtccttcttagagataaccrttgtttccaggtgttgtgtacttccaaagatgtctgcttatgtgtttatgcaccactcgcttttcaccccaccctttcaatgactctattcccagctccc

SEQ ID NO: 1551 - DNA, 201 bp, Homo sapiens
ccttgccactgcacaagcaacacttggagagtcaccctctagagcagccgctgaccataccctagtgtgcctttcccagctttgggagactcagggcattmcctctgctatgtcacagtaatatcaaacttcactcctgcctggtgaatctcttgcaaagctgtggttcctgggaaaaatgtcttcctttgatgtgtgcca

SEQ ID NO: 1552 - DNA, 201 bp, Homo sapiens
gccatccgtgagggattcttatctttcatctttccactaccaaatctaaattcttgcttcttcacttgttttctcctgattgctttttgttagagtggaaraagggtccctcctcccatttaaggtctctcgttccacctagtgctccacactcatcattctcatctttccagtgatgtacttatttgcctcatctcatgc

SEQ ID NO: 1553 - DNA, 201 bp, Homo sapiens
cagaggttactgtgactgagatggttcaagggtaaatccatagtaattctgtacttaggacaaaagtatggtgttctaagtaacccctgtggctctaaggyacacaagtcatatctaatgaggacagattttcactgtgaacaagggtccctaacctcagttttgccttttctgtggcacctactctggctccagggcagt

SEQ ID NO: 1554 - DNA, 201 bp, Homo sapiens
aggtctcaggaagcttttactcatggcagaaggcaaaggaggagcaggtgtgtcacatggagagagagggagcaagacagaggggaggaggtgccagcctycttttgacaaccagctcttggagtgaactaataaagtgggaactcattcattactgcaaggatgacaccaagccattcataatggatcctcccctatgac

SEQ ID NO: 1555 - DNA, 201 bp, Homo sapiens
ttttctatcagaggtcagcaaacattttctgtaaagaaccagatagtgcatattttaggctttgtgggccatataatctctgtcaccactgctcacctccrccattgcagtgtgaaagcagctgtagacaaaacgtaaatgaacgggcatggctgtgccccagtaaaactttatgggcaccatgaaatttaattttcatgt

SEQ ID NO: 1556 - DNA, 201 bp, Homo sapiens
cagcctccccacacaacaatgaacaatgtaatttctggtagtgatcattactttgaagaaactaagagtgtgatatggtagcaagcatgagagacatgtcrtctagatcaggtgaacaggaatactgtactgatgagggaggctttggcctaagacggagtgacaagaaggatgcagccatggcatgacccagggcacgac

SEQ ID NO: 1557 - DNA, 201 bp, Homo sapiens
tgatcattactttgaagaaactaagagtgtgatatggtagcaagcatgagagacatgtcgtctagatcaggtgaacaggaatactgtactgatgagggagrctttggcctaagacggagtgacaagaaggatgcagccatggcatgacccagggcacgacatctcaggcacgaaggagacagcaggtgccatactctgcag

SEQ ID NO: 1558 - DNA, 201 bp, Homo sapiens
tgaaggtggcaagtggagaggggatggagggcccacttctgtgattctgtggccaggactctagtccctagagtttacagggcactttcttccctgctcamacagagctcaaaacccagcactcggggttgactccacctgcatgcagccagcacatcctctctgtttggcaggaagcaaatcatgttcagtggctctgca

SEQ ID NO: 1559 - DNA, 201 bp, Homo sapiens
agcctcccttgaggtgaagttaacccatccatgtgacccgttctggccaatgggctgtgggcagtggatcccctctggtccaaggcacttaaaaccaggtrtgagttctccaagttctccttttcctgctacagtaagctgaagcccactcatgttgacatgacatcagtggacagaagggatcctcaaggagaggacagc

SEQ ID NO: 1560 - DNA, 201 bp, Homo sapiens
ggaagtgaaacttgatgaaggcttctggtgaactaagtacttcccttggctgcccccctgctcaggaggccctggtagacccctcccttgtcccacaaggrgccaggcatgaggatgactggaaatgtgaagtcctagagggctgtaaaggcaggaactatctgatactgtccctgggtcatatgacaagcaaggaaagag

SEQ ID NO: 1561 - DNA, 201 bp, Homo sapiens
ggatgccctcttttctggaagactctatagcagtcctctccaccctgaaggcagccagcatctcctctcagtgcttctgcagctctgcaggggaaactggrtccctgatgaagcttcagcctctctcccaggctgcctcctgcctgaagcaattataaatcacggcattttcctttcattcagacctgatgtttaattcat

SEQ ID NO: 1562 - DNA, 201 bp, Homo sapiens
gctgctttaatgcagagaacatttattcagtggaatagctttgttttgcttccaaagctttattctcctgtttagaataccattgctattgcagagggggyttcctattagccagttcagagaccctccccctcctgctccccaagagtggcccagccctgccatctatgtggacccacccccgggctgagagtgagcttc

SEQ ID NO: 1563 - DNA, 201 bp, Homo sapiens
tcgtaggtaggttcattttctcacaagacttgaggccttgacacctctgtgtggctcttgctgccctcccctgagaggatcagagagtgggcaagttcctrattccttcctgcagcacagcataacaagcttctcattgggaatcgctgggtgtctggctgtggtgggtgtggaccatgcattattaagagagaggctagg

SEQ ID NO: 1564 - DNA, 201 bp, Homo sapiens
tccaggatcttaaccaccacagcacactgccctgcaagtagatgcacccatctggcatggagcagttttgacaggtatctccaaggtggcatttctaagtrgagcttgccaacacatcttgcttttctcccccaccgtcttcccccttcctaaagactggtcaccttggagaagctgccagagctcaacaggaacctcgcc

SEQ ID NO: 1565 - DNA, 201 bp, Homo sapiens
cttttctcccccaccgtcttcccccttcctaaagactggtcaccttggagaagctgccagagctcaacaggaacctcgccactgcttttgtggtgatgccraggccaagaagtaatagcagcttattatatctgcaaaaccctttatcatctattatgtctctttattctccaagaaccaagtgagatgaggcaggtgtta

SEQ ID NO: 1566 - DNA, 201 bp, Homo sapiens
gtaatagcagcttattatatctgcaaaaccctttatcatctattatgtctctttattctccaagaaccaagtgagatgaggcaggtgttactatccccacyggaagaacaggaaaggagcctagagacacccggtgacttaatcaaggtcatgcagaatggaggctagtagccaggcctcctgacttctggagcatgttcc

SEQ ID NO: 1567 - DNA, 201 bp, Homo sapiens
cattgcagtgtgaaagcagctgtagacaaaacgtaaatgaacgggcatggctgtgccccagtaaaactttatgggcaccatgaaatttaattttcatgtgycacaaagtatttttcttttgattttccaaccaattaaaaatgtaaaaacctttcttaacttgagggtagaacaaaacaggcatcgggctggatttggctc

SEQ ID NO: 1568 - DNA, 201 bp, Homo sapiens
gaagtcagcagccaggagttcctgctgtctgcatgtcctgacctagcctccacccatcccaatttggttaggttcacagtgcctacctgtcattcagtgcytctccaatttccccaggcaggaagaggcacatcttcccagtcttaccagatggcccagctgtcattcatggtcaccatcttagtctgaactccctgaaaa

SEQ ID NO: 1569 - DNA, 201 bp, Homo sapiens
ggctgcttgttcaccctgtgtgaggccagcaggtttatttacggtttctgattttatttattgccccacctcagagctgctcttctgcatacagagaactyaggctgtctgctgcctgtgctgctggggccgccataagctgggcttggatggatgtgcagctttagtccaccgagttggctgagaagctggtcgccttcc

SEQ ID NO: 1570 - DNA, 201 bp, Homo sapiens
ctccatgatggaagctgcttgtttgccaagctcactgcctgaaccagtttctgatacaagatttaagaatgtagcacctaatagaaatgaaggacagaagrgctgcagaggagggaagtgcagtctaggacacagagtgaagaatgagtggacttaattcaacctgcttgcagtacagatgggaagactgcgttttggaaa

SEQ ID NO: 1571 - DNA, 201 bp, Homo sapiens
gaatgcccaactgtgggagctttcagtgctaccctaagaagcctagcagagttcccaggccctcctgcagccctgccctcctccttttctctggggaggarcggagtgtccgggcttgggcgaaggtgctatcactcagtcctcatggtgttccctggatggtgacctcctgattcaggttgttattattcccattttgct

SEQ ID NO: 1572 - DNA, 201 bp, Homo sapiens
ttgtcctgggctgggctgtcagtcatttgttccaccccagcatcacagaggtggggcccacctcccccgcaccaccacccacagccccctactctagaccyttccccacacatgcccaggcaacctcctggtgagaattgcacccgaattcaattatctttgtggcttttggctaaagggatccacacacagcaggcaggt

SEQ ID NO: 1573 - DNA, 201 bp, Homo sapiens
atcaaacaatatagaaattcacaatattcacaatattgaaagtaaaagtatcttataatcccacctctctctccccaaggtaactactcttaacagtttgrtatgtatttttctagactttcccatgggtttgcaaatatgattgtacatttttaaaaaatgaaattatgctttgctgcaatttgctttcttcaacttaac

SEQ ID NO: 1574 - DNA, 201 bp, Homo sapiens
gggtgttagctattactattttccagaattactatcttctagatcgagatccccttgcagtagatggttgacattttaaagttttgcttgtttttcatgtyataatatggtcataagttccttgatagcagggagcatattagtctttgttcctcaatacttaagactggtacctagcacatagtagatacccaataagaa

SEQ ID NO: 1575 - DNA, 201 bp, Homo sapiens
tcaaggactaacacccgtcctccccatcccaccccatcctgagttcttcagccttgtagtaaattacattacctccttcctggttctccagcttgcagacrtctttgtagggctccttggcctccacaatcacatcagtcaattctcataataaatctcctcttgtatatctatatatatccttttggttttgtttctcta

SEQ ID NO: 1576 - DNA, 201 bp, Homo sapiens
tgggagcttcactacctgttctattccagtctgctcacttttcagatgaagatgccaaggtccaaagtaccaagaaggctgcttcacggtcatgtggccarcttgtcccagagctaggattagaacctgggctttcccactcttggcccaatgctctttacattacggcattcacagaggcagtggcagaaacatagtagg

SEQ ID NO: 1577 - DNA, 201 bp, Homo sapiens
aggcagcaggctcacagctgccctctcccaacattaagacaaatttataggagtgccagcaaggcgtaaaacacacgaagataggctgttcctcactccascctggctattcaaccccctcactccttctccaattctgcttcctcacctgcttcccgtagctgaaggcagaagaatgccttaaagacccttcagtcaccg

SEQ ID NO: 1578 - DNA, 201 bp, Homo sapiens
cgccctgcagaaggctgaagccaggggccattgcattgtgtgacatggctcagcctttccagtttacagtccatttggacatccattatttatggcagccragtggctgtgaacaagctgagactcaattaaggtaacgtcccccacacagaagccatggttaatgctgagaagttattccaactcccaccttaccatcac

SEQ ID NO: 1579 - DNA, 201 bp, Homo sapiens
agaagttgaacagactttagctacattaccaaagctattaaagttaaaaaccactaaacaaccacagcttgcttccaatcatccaccccacaggcattcaraacaaaaccaacaagaatgtgttagaataaaatggacactgaatcttattaatgtcttgagtttggagctttaaaagcaaacccctggcactgaggacat

SEQ ID NO: 1580 - DNA, 201 bp, Homo sapiens
actttagctacattaccaaagctattaaagttaaaaaccactaaacaaccacagcttgcttccaatcatccaccccacaggcattcagaacaaaaccaacragaatgtgttagaataaaatggacactgaatcttattaatgtcttgagtttggagctttaaaagcaaacccctggcactgaggacatcaaccagtaggca

SEQ ID NO: 1581 - DNA, 201 bp, Homo sapiens
gctattaaagttaaaaaccactaaacaaccacagcttgcttccaatcatccaccccacaggcattcagaacaaaaccaacaagaatgtgttagaataaaayggacactgaatcttattaatgtcttgagtttggagctttaaaagcaaacccctggcactgaggacatcaaccagtaggcattgttgagcagcacggggtc

SEQ ID NO: 1582 - DNA, 201 bp, Homo sapiens
cttccaggagcatccttacacccccaccctagacacctctaggtcctaggctaattttcaggatccatgatgagaaggcatttgtgaacacagatgtgacwtgggggatagtgggtggggaatacctctggcatgggaggtcagtgagtcagagctgaagaccctggggcaggcagagcaaccagaaggatgggggcacca

SEQ ID NO: 1583 - DNA, 201 bp, Homo sapiens
caggcagagcaaccagaaggatgggggcaccaagtgggagctaagatatgggaccaagggaagccctacatgtatgagcaagggcattgactgtgagtcartcttgggggcagaagtagccaacagcttcagagtctgccaacagccctccttctgcattggcaggctctacaaacagagggaggttctgcaaacagcgca

SEQ ID NO: 1584 - DNA, 201 bp, Homo sapiens
tggaggaagggccaaggtggaggctccagcaaaggacagtgaaaagacgctgaagtcaagctgagagaagagaagctgcacgcagataaagctgcatgcarataaagactcagataaaacatttatactatatttaacaaaatattgacatttgtaatgtagggtttttataaataattataaaggcaagtctatagaaaa

SEQ ID NO: 1585 - DNA, 201 bp, Homo sapiens
gcagtcactgccgaggtgtagagagaagtggtgctgctgaggcagggtgctgtgagaggacaccgcatgtggctgattctgcagcaatggccacaatgaawggttcggctgagaggctgtgaggtagggcacatgagtgtcagattcacaatgcagtcgtaacagaacaagaaagcacagccagcaaggactgtgctcagc

SEQ ID NO: 1586 - DNA, 201 bp, Homo sapiens
gttgttaaaatcattgaatcaaaggaaggtacaggtagggaagaatagagggtctcggaactgcacccagcattggaggaagggccaaggtggaggctccrgcaaaggacagtgaaaagacgctgaagtcaagctgagagaagagaagctgcacgcagataaagctgcatgcagataaagactcagataaaacatttatac

SEQ ID NO: 1587 - DNA, 201 bp, Homo sapiens
atgctgcaccacctcctgacgataaacctcctgggtgatcatttccattgtcctggatctcagactgctaagtgtctacaaaatacccattcctcctctawtttgtatcaacaaaaccctcaactgagcaccaggcttgaaacccagtttacatataaaactacattacccagcctctcttgtagctaggtgtgttcatat

SEQ ID NO: 1588 - DNA, 201 bp, Homo sapiens
agcaaattacaagtttattttatcttttttcttaaagtaagtatgttcctcaacctgaaaatggcttaacatctaccttaagttattgtaggccttaagargcaattctccaaaaatctgtttcctggaaataatgaactcagctttctcagtagttcagcattcttttctacctggttagtttgcaaatgtgtggtttga

SEQ ID NO: 1589 - DNA, 201 bp, Homo sapiens
ccctccttctccatgcctttctcctgtatcccacctggcacctcccaaacactatctgccgctgcagttccttgttgaactgttctggttttaattccatyccctgcaattggagcctgaataatgagttatttcacaggaagattgatctgggtattagggcatcatttagtttgccattacaacagccaattttggtta

SEQ ID NO: 1590 - DNA, 201 bp, Homo sapiens
cgcacgtgcacggtggtctctgactccgctgcgccccttttgagcatcttgggaaagcagtagaccctctccccgggaggaagtgtacacacatctgcaawgcggtattttgcaaataaattctaatagttaacagaaacttctgcagaagctgaagttttctttagaagattggttaagaactcctagtatagaactaca

SEQ ID NO: 1591 - DNA, 201 bp, Homo sapiens
caagtctatgctattctttattaattaatttctgttttccaaagagaacccgaggattcccctacctgaggtttgaggtagaggctcccattcatttctcygcgtatctctgcacgggtgctttagctagaccttaactgagagaccactctgggggctctcctctccccttactccacctcccagattccaacaagggaa

SEQ ID NO: 1592 - DNA, 201 bp, Homo sapiens
atgaggcaggtgttactatccccaccggaagaacaggaaaggagcctagagacacccggtgacttaatcaaggtcatgcagaatggaggctagtagccagrcctcctgacttctggagcatgttcctttcatctctctaggatgccctcttttctggaagactctatagcagtcctctccaccctgaaggcagccagcatc

SEQ ID NO: 1593 - DNA, 201 bp, Homo sapiens
ttgacaatctctacattagagctgttgtatttgctatctattgtcacaataatgctatctaagaaaccatcccaaaactcagtggctttaaaccatgaacrtttacacagtaggtcagtgatttaggtgaggcttagctgtatggttcttctgatcccagccaggtttgctcatatgcctggagcctggaggtgggctagc

SEQ ID NO: 1594 - DNA, 201 bp, Homo sapiens
gtcacaaaagagaatgaaaatgttgagaaaacacagaaggaccacgagtaaaactaccaagaacatcagcatttaataggtgaacagaagcaagaggaatsaagcaaatgagacaaatcctaaagagaagagaacctagaaaaatggtgtcatcaataccaagaaaagtgtctcatgaaggggaaaatggaagacagagta

SEQ ID NO: 1595 - DNA, 201 bp, Homo sapiens
ggagtatgccacctcgctcggctaatttttctatttttttgtagagacaggattttgccaacttcccaaggctagtctcaaaatcctgggctcaactaatscccctacttcagcctcccaaagtgttgggattacaggtgtaagccaccacacccagcctaaataaatgttaataggagcaataataacttaatttttttc

SEQ ID NO: 1596 - DNA, 201 bp, Homo sapiens
gcgtcactgcactccaggccgggcgacagagccagactcctcaaaaaaaaaaaaaaaaaaaaggttggtattcccttcaaatttctccactgcaaccaacyattccactaataccctgttcccacaaactcaaactcaaaatcttagactaattattttattgggcaaagtctctcagcctttacatcccatctagtgagt

SEQ ID NO: 1597 - DNA, 201 bp, Homo sapiens
attgaagaaactaatctggctgcaattgggtgttcacactggaaagtggtaaaaaattaaacctagacagtgagagtgagactagacagtgcaaagtctcyaatggcagataaataagggatttggattttatgacacacttgtaaagtacaaaactagttttcatagagccgctctctcaacttattttgttgcactgta

SEQ ID NO: 1598 - DNA, 201 bp, Homo sapiens
gatgaatgggaaaacaaatatgtagatatccaggatctttctggaaggcaggtagaaacagcaacattcacgaaaatagggaacacaagaggaacagatgwaagaagaaggaggggtccaatttgagctgtgttggctctgaagtacctatagttcaagcaggtggatgtgtagtagatggtccatatctgggagaaacat

SEQ ID NO: 1599 - DNA, 201 bp, Homo sapiens
agaaaccgtggaggtcttttgcaccttgccgtttgcctcccaggttcaacatgataggatgtggattatcagggcctgggaacagtgtaaaggaacgcgcrggtccccaccctaagcgcgtacgcggggcctcgctttagaaaataaatgaattctaccaaaaatcctatagttttaaagctggaattgaactgactctct

SEQ ID NO: 1600 - DNA, 201 bp, Homo sapiens
atgtggaagaaaaattataccattttctagaaaatgtaaatgaaccacttaagctacagaagcacctgtccaagatagcacgatagcatgccccactgtcygctgacaagtgggcagattgagtcataaaatggaaagagaagaaagttctgaattgatttcacagtcctccttttctatactacaccgttctcttcttca

SEQ ID NO: 1601 - DNA, 201 bp, Homo sapiens
cagcctgggtgacaaagtgagaccctgtctcaaaaaaataaaataacaaaaatatagaaaaaggaaatgtgacaatatgttgataatcaatgaagctaggygatgggtatatgggagctcattttactattctatttttttttttttttgagatggaatctggctgtgttgcccaggctggagtgcagtggtgtgatctca

SEQ ID NO: 1602 - DNA, 201 bp, Homo sapiens
ttttgatttcgcttctcactaatacggcatgacttggagtttgaaaaacattgtattcaaatagtcaatataaatgcaaagtagacaaaagcaccagctaracaaatgtaccagactataccctgagaactggagacccgttcataggaacatgattaattgacttctccaacaaatagtagctcaaacatcaaaacttgc

SEQ ID NO: 1603 - DNA, 201 bp, Homo sapiens
actaatacggcatgacttggagtttgaaaaacattgtattcaaatagtcaatataaatgcaaagtagacaaaagcaccagctaaacaaatgtaccagactrtaccctgagaactggagacccgttcataggaacatgattaattgacttctccaacaaatagtagctcaaacatcaaaacttgcagttgttgctaaaccat

SEQ ID NO: 1604 - DNA, 201 bp, Homo sapiens
tccagcttgagaaaacatatcactatcagacagacatccattttcctggagataaagcatatatcaatgagaatacatctcagctaacaatattttgatamgccaaagatcctgttttcctgattatttgaatcaccatattctctgattttctagaaaaatagataagctcagtaattgaattttagcaaaaatttaaag

SEQ ID NO: 1605 - DNA, 201 bp, Homo sapiens
ctctctaataaataaagaaaaactaccagaaatttggggaaaacatgagaaccgttaaaatacatattttatttttctcctggcatcaacaggacaacatmcacactacatccacagtgagatatttctgcgtttcagtcaaattcagctctccctgttaattgaactaaagaaatctaaattagtatcttttcattttcg

SEQ ID NO: 1606 - DNA, 201 bp, Homo sapiens
tgatttgccattgtgtaagaatcacaccttacactgactcttcacataacccttgccaaactagcaagggatgagatcacagtaggcattccctgaatttrtttttccctgtaattgtactaaaatgggaccatgttataagtaatagagttaatcttttcactataaatgtaatgtggctactgaataatacaaaaagga

SEQ ID NO: 1607 - DNA, 201 bp, Homo sapiens
cctgtggagagctgcctattagccaatgaaaaaccaagattaacaaagatgttttgtaacaacagtaattttcctttgcattcaagcataaaatgtatagsgccatgttacagtaatacctaggatagaaatgtaaactttcaagaggggtaccatcttacagaaaactatatagtctagcttcattatatgaaaaatgaa

SEQ ID NO: 1608 - DNA, 201 bp, Homo sapiens
gatctccttctggacccaatgggagccaccacaatgcttaagtgtaagcaggaaaatgacatgatcaaattatcagggagactagggaatgatgaaggggytggaggaaaagggatgcattccaaatgaagcagatctaacagggcttaatcatttgtgcaatcaataaatggggggtgaagggagtgagagatgaatggg

SEQ ID NO: 1609 - DNA, 201 bp, Homo sapiens
ctgagcggcaggtatcattaaaaactttttgtagaagcttctttggaatgcggccagttcttcgaacagaaagatctagtctcattagagcccaatcaaaytgattggaaatcttcctagaagaaaaagtggactcctcttgaatatctttttctttggcagcaatggcatacagcctggctgggctcagtagtcctctaa

SEQ ID NO: 1610 - DNA, 201 bp, Homo sapiens
caaatcactaaccttgggcaaatcatttaacttctctatgcctttagtcatctatcaatggagataattgtattaacatgtgatgagcattataaagcacrctagtgtttaaaaatgtttagtaaacatttgctgtgtttttgttaatgaagactagaagtctttataatagatgttagtttaaaaaacacttcagaaaca

SEQ ID NO: 1611 - DNA, 201 bp, Homo sapiens
aaaagccatagccgcagcctatcccagttactaccagctacatcttccccaacaacatcccaagctgaggccactttcattcttccctctctcaccaatckcaagtcccccatgaggtatcactccatgatgcccctccccccacccccaggcaggtgcacctgtccatccattcattctgcagaacaaagctaggctccc

SEQ ID NO: 1612 - DNA, 201 bp, Homo sapiens
ccagctacatcttccccaacaacatcccaagctgaggccactttcattcttccctctctcaccaatcgcaagtcccccatgaggtatcactccatgatgcycctccccccacccccaggcaggtgcacctgtccatccattcattctgcagaacaaagctaggctcccagcactgcagggacttgcccaaggtcccaccaa

SEQ ID NO: 1613 - DNA, 201 bp, Homo sapiens
cagaacaaagctaggctcccagcactgcagggacttgcccaaggtcccaccaagcccagagtgaaacccagctcctagacatccctaccaccaccttcccratttaggaggagtccccgagggcatccctagggcagagggcagggccaggctcctaaggggcggggccatgcaaggcgagcgaggggccggagggtgggg

SEQ ID NO: 1614 - DNA, 201 bp, Homo sapiens
cacttgagcccacttccaagaatggcccgggccagagaccatgcctcacttgcccacaactgccccctcctgctggcatcgagcagaaaaagccatagccscagcctatcccagttactaccagctacatcttccccaacaacatcccaagctgaggccactttcattcttccctctctcaccaatcgcaagtcccccatg

SEQ ID NO: 1615 - DNA, 201 bp, Homo sapiens
cggccccggtgagcgtctgagtttcccacccctagttcttgcctctcaaaagcctttccaactggtgatctcactagaggcatcactaggcccagctgacmgataaggaaaccgaggctcatgaggggggcagcaacttgcccacagttcccaaggaaggggctgtggagccaaggtgagagtgcagccaccagtcccagc

SEQ ID NO: 1616 - DNA, 201 bp, Homo sapiens
ctggtgatctcactagaggcatcactaggcccagctgaccgataaggaaaccgaggctcatgaggggggcagcaacttgcccacagttcccaaggaagggkctgtggagccaaggtgagagtgcagccaccagtcccagcctgtcttctctcctgagcccctgtgccaccacgacaggttcagggaagcctccctggcagc

SEQ ID NO: 1617 - DNA, 201 bp, Homo sapiens
ggggactggcaatgacctcaacagacatggcactgccctgaggaagcccacggctccaagggagtcagtcaaacagggtaccaggaattacaagcggaacrtgcgggggccgtggggcctaggccaggtggggctgcctggtcttccagaggaagggtcacctagctctcaggcctattggagacaaagggtctccaaaaa

SEQ ID NO: 1618 - DNA, 201 bp, Homo sapiens
aatcacacagtgggccctcaggaaacacggccccagctggacctgcagaaatcactagaaacagcccaaacaaaccatccctgcacaggagctgcctaatkcgagcctgggggccaccgccctaggaggcgcgtgaggtttcccagtaaccaagccggcccggcagccctccctttaatgcatgcaaacgaggggcataaa

SEQ ID NO: 1619 - DNA, 201 bp, Homo sapiens
agcctgggggccaccgccctaggaggcgcgtgaggtttcccagtaaccaagccggcccggcagccctccctttaatgcatgcaaacgaggggcataaattyctgcttacttaacttcacaaatgttaacaagcccataaaaaataagttattcttccccagctccacaacacccttcgtttgtttaattttgcttctcctc

SEQ ID NO: 1620 - DNA, 201 bp, Homo sapiens
atgcaaggcgagcgaggggccggagggtggggatgggccgagagaagactggatcctggtctgggtcccggttgcctgggcaacaggactaattaattccractccatctgtgccttggctggatgggcggtttgggctcccgggtgtttgttttgaagcaaagggagagaagcgagagggcctgggaggctgcggcctcg

SEQ ID NO: 1621 - DNA, 201 bp, Homo sapiens
gagttaaataccctccggttaatccatttgtagagtttgtcttccggggcaagctggcagctccaaaggcagcctgtggttcggttttgttggcagactcsgtgttgacacacatttgagttttgatgccatccaaactgaccgctggagtttgccacaggcccaccacaccctattgccctacacagaccagacgtgcgc

SEQ ID NO: 1622 - DNA, 201 bp, Homo sapiens
tccaaaagtatcctaaagtctctgggcttttgatgctgctagcttgaaaattactgaagaaatttggtctatttttatttctgccacagactattacttayacaaaagccttaagggggtttctctcggctaaaaattttattgaaaacacaagattcattctattataatcttcatcctgatcatttcgttgtaagaagt

SEQ ID NO: 1623 - DNA, 201 bp, Homo sapiens
aggctgaggtaggagaatcgcttgaacccgggaggtggaagttgcagagagctgagattgtcccagtgtactccagcctgggtgacaaagtgatactctcygtctcaaaaaaaaaaaaaaaaaaaaaaaaaaagaatcattgtttatttttaaaaacaataacgactaacatatagaaaatgcttagccacaacattaagc

SEQ ID NO: 1624 - DNA, 201 bp, Homo sapiens
ctcccaatatgcatatccctaggcaataacttgggcaattcacaaagtgctttcccccttattctaggtctccttgaactacggaactcttagcatgataytcactgatgcccaacaagcctgcttcactcaagtaaaaggctgaatgaaagaaactgcctcttgaaagaatctgatcctctgaccagggtgcaggccggc

SEQ ID NO: 1625 - DNA, 201 bp, Homo sapiens
ttctctattttcaaatggtcagtcattgctgaagctacaccttgtagcaagagagtgaatgcctccagactgtcaaagaaaggacgctatccactgccttycttctcataatccaggtgctacagagtcacgtgcaagcatcctccaagaattcattactacaacttggacaggaggagataaaggggctgcaagatgttc

SEQ ID NO: 1626 - DNA, 201 bp, Homo sapiens
atcaagggttgggaaattttttctgtcaagggtcagataataaatagaaaataggctttggaggctgtgtagtctctgtcacaactactcaacactcccamtgtggcataaaagcagccataaaaaaaaatacaataaccagatgaccaggttccagtaaaactttatttaccacgacatgcagtgggccaaatctgacct

SEQ ID NO: 1627 - DNA, 201 bp, Homo sapiens
gtgaaccactacataatgtatcagggccatcttcctcaatttccctcataaaaataatacctgcttgctgtaaactacaccaacgagtcacctatgtcacrgcccatttcccatttctcttgccccaattccaatcctcagaggaaggtagggtaaacacataattcaccatccaaagcagttcaccaaacactgaaagag

SEQ ID NO: 1628 - DNA, 201 bp, Homo sapiens
actaaatgaacagaattttgttatgcaaatacagttgcaaagaaaaagaaatatctgcagtattctgatgggggggtgtcttttgatttagctttttctaktactatcaactctatatttactttcagctttagaaacccttttaccttcagtgctcagtgtctcccaaattctattccatgcaagcctaataagccaaca

SEQ ID NO: 1629 - DNA, 201 bp, Homo sapiens
cacaacacatataagccaacttgaaatttttgtctttacaagcaatgctatatagagaacacagccccacatatatcttttatgagtttgagtatttccaragaataggtttctagtggtagaaaggctaggtcaaaatgttaccatttttaataggttcttctcaatactctccaaagaggccttatcaaatcatttcaa

SEQ ID NO: 1630 - DNA, 201 bp, Homo sapiens
tggcttctctcttctcaacagcacctccctcttccttagggaaccatgttttgctcccagtgcaacagtcaaaaggcccagataaggactgaccccacccrttactgcaagtgggcaccaatttgcataagcatcaatgattagggattgcagaactaaggcattcagcacacagtacatgacgttcctctgggtctctct

SEQ ID NO: 1631 - DNA, 201 bp, Homo sapiens
caagagtaaaactctgcctcaaaataaaaaaagtaaggaatatctgaattcaagacctggttctacccctgactacctacacaaggtaaactttccaaggytcctaagaatgcctaacgatacctacataataatgttactgagagaattaaacagtagtgtctacaaagctctaagcatgaaacttaacacatagtaggt

SEQ ID NO: 1632 - DNA, 201 bp, Homo sapiens
gcaggacttgaaagctttctcagaggaagccaagtgttacctgtggtatttaaatggaaagaggcctgttgagtcaagtgccttcccagggaactggaggsacaccaatttgcccaaagtcatccctggctggggaatataatagagggctagagttcagacttttcttccagctgatgattcatttaggacaaaagaatt

SEQ ID NO: 1633 - DNA, 201 bp, Homo sapiens
gttatttggctagcacacactcataagtagtctcctaattgattctcagttgacagggtgttgagcatggtaaactctgggaaagagaaaagggcccaacmtacctaatccttaaaaataagccatacataccctcaaataatttagttcaggcacaaatccactccctttgtgtgtgagacaaagtctatataccaacac

SEQ ID NO: 1634 - DNA, 201 bp, Homo sapiens
gggcagctggacaagggtgatcacctctcttaatgagtcagctaagattacccatcatttacacatgcaaagaagaagcaacacaacaccaaagtgctccwgaatagatacttttaggcacagttcattttgcctgaaaaatcctctttctacccttctgtccatccaagtctcatacctacatcaaacccaccaaaggtc

SEQ ID NO: 1635 - DNA, 201 bp, Homo sapiens
caacctgggcctactgaatcaggacctgcatccccagataattcacaagcacagtcaacgtgtgaatttacaatgctgggccctacaccatctggtgaacygagagatttcaatcttttcctcatctcctcctccatttagtctctaaaacatgagcacccaccacatgtaggcactatacctggcaggcacagcaatgcc

SEQ ID NO: 1636 - DNA, 201 bp, Homo sapiens
cccaaggagaaagtaggagttagtcagtgcgggaagacgcaagcacttgtgtctcaacacgcgcagggcgcggctgcagatggaaaaaccgggaagctccrcgctgcaatgagccaggctcgcagtgaaaccatcgccaaggcaccaacgtctccctcccaacggagggtgcaaggaagggtgcctggcctcagctttctt

SEQ ID NO: 1637 - DNA, 201 bp, Homo sapiens
gttaagtatttgtctttttattaaagatcagaaagacaaagctcggagaggttaagtaattgccaaaggtcactcagctaagaaatgctggagcaatgccmcaggtcagtccaagttcaaagtcctggatcttggtctctccatgctactgtttttagtaaacttctaaggccaagagggcatcacacccttttgagttct

SEQ ID NO: 1638 - DNA, 201 bp, Homo sapiens
gtctctccatgctactgtttttagtaaacttctaaggccaagagggcatcacacccttttgagttctggatgatatctcacctcttcactggcaagaataraacttgaaagaaattggactctctaggccaagaagaaaatcccagagagccctgtttgaacctgtcacctccgggcagctcttccttttattcatataca

SEQ ID NO: 1639 - DNA, 201 bp, Homo sapiens
aaggcaaaattattaggaatagaaaatggatataattgcttggaggaggtggaaaggattgactacaaatggtcagtagaaaataattttaggaatgctgwtttttaggggtgatagtattattattctatagtttgaatgaagtggtagttacatgattgtatgcaactgctgaaactcagagcactgcataccaaaaag

SEQ ID NO: 1640 - DNA, 201 bp, Homo sapiens
ctgaggatgatataattcaaaatttccccttttaaaggagatgtactttaaaactgctacttagctgtcccccccattcgtctttaattagctgcttgaayaatgctgaatatattacatccttgcagagagctaagtcctcaagcaattagtctgtcctaccaaatgtgacctacatcactactgtgcccaggataggca

SEQ ID NO: 1641 - DNA, 201 bp, Homo sapiens
tctataaatggcaaagaacttcttcaacctgatgaaaagaatttatgaaaaacctgcagctaacatcatagttaatggtgaaagagtgaatgttttttccytaaaattgagaacaagaatatcttcattacccttttctgtctaacactttactagaggctatagccagtgcaataaagcaaggaaaggaaataaaaagca

SEQ ID NO: 1642 - DNA, 201 bp, Homo sapiens
taaaatacccagcagtaaatctgactggagatgtaaatgacctgcatagaaactaaaaaaaaaaaaaaaaaatgtactgagagaaattttaaaatctaccytattcatgggcaatacttttaaaatgtccattctccacatattcatctatatctagatattcaacgcaatcccaaccaaaatcctaccatacgttttgtc

SEQ ID NO: 1643 - DNA, 201 bp, Homo sapiens
gcttattaatagacgtagaggctatcaatacccaatcaggagtccaagtgcccccatctgtttctaaacgtttccatttttaattggttgatttttatttytcatggatgacagacactttattggcctcctctctggaatactatgactattggttgcaagtggaaagaattactaagcaaaatacagccagtagtatca

SEQ ID NO: 1644 - DNA, 201 bp, Homo sapiens
tcttttcctatatcattaacaggtaagaatcaagttgtaaacagaagaattaggaagccaaaaagcaggaaagctgagcaacacactcaaaatctaatcgstgcctgagaaatcaggaattgactctaaacacttggacacagcatgtcaccaacacagtccaactctagtgaggaggaggagagcgaggaagaggaaact

SEQ ID NO: 1645 - DNA, 201 bp, Homo sapiens
cctggaatgtacccctgttgataagaaggggactactgtattttctaaaaaacaaaaccataaaacttaccacgttttatcaaatctgaggcaacaattayagcttatgaagcaacaaggcagaagaaatactgccaattaagttacagaatgccactcattgtagaatgcattttgaattctgaaatattaaaatgtaga

SEQ ID NO: 1646 - DNA, 201 bp, Homo sapiens
cacttagaataacattccaccccatctctataaatatcctacagacaaatactaccttccccttaaggccagttctaaccctaactgacaacaaatcatckctacatgatcttttccttctgggaatgcctgcagcactgtttaatcctgccccaccaccatcccctcacccagcaccctctcccagaccagacagggtgg

SEQ ID NO: 1647 - DNA, 201 bp, Homo sapiens
tattcattcgttctacacctgtttagcgcctgctctgggcaaaaccttgtgcagggtgctgtatgttggctcccaaaggagaaggattgctgccaagtttsctctagggcttgagccatgttgactattaaataccagttcagggtgttcagtaaagtctctgataatgctccataactttctaattagtcaagcctttaa

SEQ ID NO: 1648 - DNA, 201 bp, Homo sapiens
aaatagctataagacagtactgatcatttgatgcacaaaattaggcaccaaatgagggctttaactcattttttcagttttggcaaatatacccaacctcrtaacagattaaaaaactaaagttctactctttgggtggagataaaaaataagcatatatgcacaaattagaaaaaagtatacaggagaaagggacagaaa

SEQ ID NO: 1649 - DNA, 201 bp, Homo sapiens
tggcttcaagcaattctcccacctcgacctcccaaagtgctgagattacaggtgtgagccaccacacctggcctgaagatcacatatgtcacgtaaagtcwattaagcttgactacactcagggtacagtgcagatgctgggtcccatggcgctcaagagggaaggagtccctggacctgcctcggtagaactttatcagt

SEQ ID NO: 1650 - DNA, 201 bp, Homo sapiens
gtttaggtattgtaggtagatctgtactttctacataaaaagggtaagttttgtttcactccccaagaaccagtattcacctcccttaggagagacatcasttccctttgagaaggcatggtcaagagtcactttggcactatgtgatatagagtcatgcagtgcttgctaaatattagcaaatataacagtaataatcat

SEQ ID NO: 1651 - DNA, 201 bp, Homo sapiens
atgtactgttttgatttcacctgactagaacataaaccctataagggatcttcatctgttttggttgatcatatataccaggcaggcagaacacagttccyagcacataaagattgttaaataaatacttgttgaataaataaatatatcttagtgtttctgtgaggactaaatcagccagccctagcacatagcaaccta

SEQ ID NO: 1652 - DNA, 201 bp, Homo sapiens
aggcttattaactaagagtaagatacataacttttgacattcaagtaaaatctcactaatttggattgtataaatttggaatctcttatcaaaagttaacmtttgctttagttacagacatttaaaagaatttgatgaagcaaataaaatgtgtaaaatgattgccacgggcgtatgctggttactcaagaccacagtttg

SEQ ID NO: 1653 - DNA, 201 bp, Homo sapiens
tatgtttcataaaaccacttaagagatagaagattcttgcaacatctcactgtcacttagctagattcttaccgtcttgtcaaaagccactccataattcrtattactttttttctacttgaaattgtgaatatgccttactttattttaaaaacttatttaccaccctaattttaatcattttttttttttttttttgag

SEQ ID NO: 1654 - DNA, 201 bp, Homo sapiens
atatacccaacatgaggaaacagggttagagatttacagatatttgcatgcttttctttccggcaaatgcaaatttcttaaggaaataaaaagatctaaamattgcaccatgtcaaatgaaaatgagtgcaggtgagagcaagatttgcctgttgcaatatctttgcctctcacttagggaacaagagagcttcttttttt

SEQ ID NO: 1655 - DNA, 201 bp, Homo sapiens
gctctccctaccccatctttctctctccctccctcccttccttcctttcttctatcctacttttctttctttttttctggtgtgccagtgctggttttcayataaaaacataaaatatgtttagagcaggatttttattaatgtagttcagacacttgtgttaggcaaataggcaataaacttcatgctgatcactttctt

SEQ ID NO: 1656 - DNA, 201 bp, Homo sapiens
ctggttttcatataaaaacataaaatatgtttagagcaggatttttattaatgtagttcagacacttgtgttaggcaaataggcaataaacttcatgctgmtcactttcttagaaaagttattggtaaagactttaataaaaactatctgaataagtataataagcctttacttactaccagtttccactttcaacaatga

SEQ ID NO: 1657 - DNA, 201 bp, Homo sapiens
gccactgtgctgggagcccaagtcttgcctggttaggagcagtggggctgggtggagtctgccatatgggtgtttcctgggagaacacagagctgtgcccrcccagagttcaaacaagggcagggtcactgtgctggaagcagaaactgagctttgtctggtgagaagtggtacagtctgactgctccccagcaccatgac

SEQ ID NO: 1658 - DNA, 201 bp, Homo sapiens
tttggcatttcctctctgcttcatcctttaactcgctgcctctggttaaagaagccggcactcccaaaacagtccccgaccacactcccttccacacatayacttttcctagcaacatctgtatggctctccccttaacactcagaaattgtaaatggcaacattgttgaaagctttactgatgaatattccaggttatag

SEQ ID NO: 1659 - DNA, 201 bp, Homo sapiens
gccaagaaaccattcttaacctttgaacatatttctactatatgttaaatcccttggtattggtttcctcatttgtgaaatagaggaatagaatgagatgractataagggttacttcagctacaaaaattctaacatacaacataatgagcaagagagctgcctccacatttacatactaattaggaattttttagctta

SEQ ID NO: 1660 - DNA, 201 bp, Homo sapiens
tacctgacaagatttttcaacacttctttgttggccttaacttgtaggagaggaaacccatagaaaggaaacagactgttaaatggaagaaaagtcatgtracttcctcttttagattatttacaggctgtgaagcaaacagtgaagttaccaaacctgtagctaaatctataaaatatatcatgtttgcacaacttcatc

SEQ ID NO: 1661 - DNA, 201 bp, Homo sapiens
tttgcactgacctactgtttgatatgcctccctctcagggcttgtcataaccacagtaatattccttccctttgtagctgggctcttgatcaaggtctccrtaaccccccattaccatatttctcaccagcttcagtctccatgggctcttgatattaaatctgtggccattattgataagctgcattgcctaaattgtct

SEQ ID NO: 1662 - DNA, 201 bp, Homo sapiens
caatgccttgctaggggaggggcatgataactatttgttgaatgaataaatgcatgctccaaagagaaatcagagggataatgatgggatcaaaagaggamgaaaataaaccttccccaaaatgaagaccatgtatcatataaaatggcccatcaactgtccagcacatttttttcaaaacccgtattaattattaatgct

SEQ ID NO: 1663 - DNA, 201 bp, Homo sapiens; identical to SEQ ID NO: 1227

SEQ ID NO: 1664 - DNA, 201 bp, Homo sapiens
aaccacatgtcagtagcatgtttgctttcagggtacatcaaatgcattctatagcacaggatgttccagtcactctaacaaaagatgtcctgtttggaacrccaactctgtatcagttacttcagacactttctctcattgagtcccttcagcaagcccttttaggtttatgttcttagatgaggaaaccaagtcttagaa

SEQ ID NO: 1665 - DNA, 201 bp, Homo sapiens
ataaaaataaaataaaataaaaaatgaaaaacaaagtccacttgtaaccacatgtcagtagcatgtttgctttcagggtacatcaaatgcattctatagcrcaggatgttccagtcactctaacaaaagatgtcctgtttggaacaccaactctgtatcagttacttcagacactttctctcattgagtcccttcagcaag

SEQ ID NO: 1666 - DNA, 201 bp, Homo sapiens
atacatactggagtgaagctccaggaaaccctgaggagaagagaagggcttaaagagcaatcagccttcgattgctgggattatgaaaggtcgtaagaagygaatgttgcaatgttttattatacttgatattgaagcaaggacaagtaataatttattattctctccatgtcagtggtatttacctttttggaatcatgt

SEQ ID NO: 1667 - DNA, 201 bp, Homo sapiens
tccttccactgactgagactatttccttgccacaatcagaagaactaaaagaaaggaggatatctgttaatatatgaatttatctaaatgtcatgcagtgrcttctaaaatcatctggtgtgctctgtttccccttggaggtgacttaggcctggcatcccaaacaatacatactggagtgaagctccaggaaaccctgag

SEQ ID NO: 1668 - DNA, 201 bp, Homo sapiens; identical to SEQ ID NO: 1524

SEQ ID NO: 1669 - DNA, 201 bp, Homo sapiens
tttgagaaaattctgttcttatggtctctatttcctctaggaaggagaaattagggttatcttttgaaaacacttttgttaaagggtcagggaagggggtraggatgaagtgagttctaaaatagctgtggaatgggagagatgactcacaaagtaaaccaggattgtagggcagcattaaagttttagtagagagcagga

SEQ ID NO: 1670 - DNA, 201 bp, Homo sapiens
gagagatggaagagagtggtgatgagttgggggaaggctcatatctgagaccattcctccaccagtccaagtcccaaggccaaggtcagggaccactcacraagcgggaggagttgtcgttccggacggtcttggcattgccaaaggcctccagagcagggttggcctggatgatctggtcctccagggtgccctgcagag

SEQ ID NO: 1671 - DNA, 201 bp, Homo sapiens
aaacaatgcttgctaaacactctttttttgatggtttcatactgttactgcgaattggaggtactctaatttatttgacattctctagttatcggacttcrtgtctgctctttcaatgctacagtcaacatggtgatgaaattttctggtttaggattacttcctcaaacttgtttcccagaaaagggctttctgggtcaa

SEQ ID NO: 1672 - DNA, 201 bp, Homo sapiens; identical to SEQ ID NO: 961

SEQ ID NO: 1673 - DNA, 201 bp, Homo sapiens
taaaaatgcagcactaaaatcacattttataagagacttgtatccctcctcatcagatgggttcacatgactttcctaagatattgaaaggttttctatcygatctttgtatgtaatatctagaagtctgaatcaaaaggttacaaaaactaggaatgagcaacgaaatttagggaaaaaaggcttaaaataacctttcag

SEQ ID NO: 1674 - DNA, 201 bp, Homo sapiens; identical to SEQ ID NO: 962

SEQ ID NO: 1675 - DNA, 201 bp, Homo sapiens; identical to SEQ ID NO: 963

SEQ ID NO: 1676 - DNA, 201 bp, Homo sapiens
ataaaataagtcttgctgactgaaacataggacaaagtacttattgaaactgtgattccattttttaggttatcctttataatttttaagtaaacagaatraatctaacatttggcatagggcagtcatgaccttgtcaggctaaaagaaaagtaaggtacacccaaataaataccatgaaggcctgaaaacctaaaatta

SEQ ID NO: 1677 - DNA, 201 bp, Homo sapiens
agatgaaaagaaaggctttcatttttgttttgtttttgaaaaatatatatgctattatgatatcattgtgcttttttctttgaactattaataggagaatkatggcattcaatttggaaacatcaagttatcctggcacttgtgaacccaaagtgtctgagacaggtctcaatcaatttagaaagtttattttgccaaggt

SEQ ID NO: 1678 - DNA, 201 bp, Homo sapiens
taaaatttggttaagagggtagatttcatgttaagtgttcttatcaaaataaaataatagtttttaaattaaaaaatatcattaagcattttccttcctascctgcagaggactagagtataggaactgtggcttattcacattggatttccaccatccagtcaaatctgtgttcaacaaatgtacttggacattaatttt

SEQ ID NO: 1679 - DNA, 201 bp, Homo sapiens; identical to SEQ ID NO: 965

SEQ ID NO: 1680 - DNA, 201 bp, Homo sapiens
ttttaccattagtatgaatgactgcttattataaatattaatatcactttaagtttcctccattggctttattgtcatgaaaaatgtgttccccttactgscagaaaactcttcatctatgtgagactagattagtcatttcacaatttttagtcactaccttcatgtgtgccatcttcatgacttttgctttttcaaagt

SEQ ID NO: 1681 - DNA, 201 bp, Homo sapiens; identical to SEQ ID NO: 966

SEQ ID NO: 1682 - DNA, 201 bp, Homo sapiens; identical to SEQ ID NO: 967

SEQ ID NO: 1683 - DNA, 201 bp, Homo sapiens; identical to SEQ ID NO: 969

SEQ ID NO: 1684 - DNA, 201 bp, Homo sapiens
taattcaaagtctcaggaataaaaatatgctttcaccaagtatgaccagcagaaatttaagtttgtgttttaattgttctgcaatttgacaatcaaatctrttcagagatatatgattacttgacacttttatgatcaaattttattgtttattttataaaaacagtacacagtgaaacaaaagaaaattattcttctctc

SEQ ID NO: 1685 - DNA, 201 bp, Homo sapiens
agaattatagaattacaaaaaaattctagaatgtcgggaccctagccagactcctactcacatttccagtacaagtctatggcatcatacctcaagcaatkgccctccagctctctgcctggaatgccccagcccacgccctggcatgccataagcacctgggcataagctccccagagcagccctcagtcagatgctgag

SEQ ID NO: 1686 - DNA, 201 bp, Homo sapiens
atgtatcacctcatttaatctcacaataatcctaggacatgggcactattattatcatccccaggttgcagatgaggaaactgaggcacagaaaaattcartcatttaaaactctcaatagccgatctagaatttaaacccaggccatctgattctagagtttgtgctcttgataatgccctgtctctgtcaataccatgg

SEQ ID NO: 1687 - DNA, 201 bp, Homo sapiens
ttttttttttccttcagcactttcaatatgtcatgccactctcttctggcccgtaaggcttccactgaaaagtctgctgccagatgtattgaggtccattrcatgttatttgtttcttttctcttgctgcttttgagatcctttctttatccctgatatttgtgagtttgattattaaataccttgaggtagtcttcttta

SEQ ID NO: 1688 - DNA, 201 bp, Homo sapiens
tccctaagtgtcggccagtctgagaaataaagagaaagaatacaaagagaggaattttacagctgggcctccagggggtgacatcacatatcggtaagtcygtgatgtcccacctgagccgcaaaaccagcaggtttttattaaggactttaaaaggggagagggtgtatgaacagggaataggtcacaaagatcacatgc

SEQ ID NO: 1689 - DNA, 201 bp, Homo sapiens
aactaatatcaatctgaaacttcctgcttaacataaccagggaacaccatttaggaggtaatgttatttaatgtcttatccaggtactaactaaaatcatrtcatatgccactgaagatcatttcctgtagtctccagtggtagttctaccatactttaggaaataaccaaaatattttcatgactttctggtcctacaat

SEQ ID NO: 1690 - DNA, 201 bp, Homo sapiens
tttgaagaggtgagtcctctgcattctagtcagaatctttcacagtcctgggtgttagaccgagcagcagttctcaaagtaaagtctaagaatccctgagsgttactaaaatggttttagggattccacaaggtccctgtctttgccaatttaagtatctgtgtgcctgattgtttcatatatttcaaccaaaccaatata

SEQ ID NO: 1691 - DNA, 201 bp, Homo sapiens
ccaactacagggacttccatctgcagggctccagctgttgcactcttaagcccacagtagggagctcgtgcttcctccgactgcccccattatttcagctwatactaatgaagaactgttagagacacagaaatcgtctgtcaattttgactgaaggactccttgatgccctgctgaaccttccttagctgcatggaagtc

SEQ ID NO: 1692 - DNA, 201 bp, Homo sapiens
ttccccaactaataaggacccacttcaacccaaacagtccaaaaggagatagacaaagcggtaaacaatgaaccaaagagtgccaatattccccgattatrccccctccagcagtgggaggaggagaattcagcccagccagagtgcatgtacctttttctctctcagacttaaagcaaactaaaatagacctaggtaaat

SEQ ID NO: 1693 - DNA, 201 bp, Homo sapiens
tgctagaggctaactttgccacagataacttttgttttcttatttctaatttagttttagccaagaatacgtgccctgtgtaatatgagttagggaaaagmtggaaataatttgcatatctaaaaaaaggagattggctgaatgaatcatgattttaaccaagtattgggattcgatccagatattaaaactgaagctata

SEQ ID NO: 1694 - DNA, 201 bp, Homo sapiens; identical to SEQ ID NO: 970

SEQ ID NO: 1695 - DNA, 201 bp, Homo sapiens
aacaaaataccatagactgggtaaattttttaacaaaagaaattcattgctcacagttctgacgaccgggaagtcgaagataaacgtgccatcaggttctrggtttcttaagggcccattcctcatagacgacaccttcttgctgcatctgcacatggagtaaagggcaaacaagctccctcaggcttcttttatgaggat

SEQ ID NO: 1696 - DNA, 201 bp, Homo sapiens
gtctccaaaaaaaaaaaaaaaaaaaaaatcctatgtaggctacatttctgcttttgaaaagaattaatagagcattttttccttacaactatttataatcrtacgcatcaatgacacgcacaaaatggccactaagagtaagaggcaaggcaataaggcccatatagaatgtttaaatcccataattttaataatcttatc

SEQ ID NO: 1697 - DNA, 201 bp, Homo sapiens
atgccttttatttatttctcttatctggctgctctggctagggcttccagtactattttgaataacaatgatgaaagttaacatccctgtcatgttctagrtcttcaagaagaggttttcaatttttccccattcagtatgatattagctgtgggtctgttgtaaatggctttttttatgttgaggtatgttctttttgta

SEQ ID NO: 1698 - DNA, 201 bp, Homo sapiens
gtggtgctaaaaggaaagttcatagcattaaatgcctatatcaaaaagtctgaaagagcacaaattgataatctaatgtcacacctcaaaaaactacagamacaggaacaaattaaacccaaacccagcagaagaaaagaaataacaaacatcagagtataactaaatgaaagtgaaacaaaaaagtacaaaagataaatg

SEQ ID NO: 1699 - DNA, 201 bp, Homo sapiens
ggcctactgaatcagaaactctgggagtaaagcccagcaatctatatttaacaagtccacctggtgattttgatgcaaataaagcttgagacccactgctsttattcttacaccccttatgtacagataatagggttggaggggctaaattaatctctggggtgacacacctggattgtaaccacacatatgtctgtttcc

SEQ ID NO: 1700 - DNA, 201 bp, Homo sapiens
cattgattctccaggttttgtcaggctgaatttctttaatacacactattgtatttgttggaaaagatataagcagtagactcttcagaaatgtctttaaytgatttttctgccagggatataagatcgaaagggtaatgattctctgtgttcactacactgtgaacagtgccaaaacatggataacgattttcactatta

SEQ ID NO: 1701 - DNA, 201 bp, Homo sapiens
agaaattgaagaagaaattaaaaccttaagagaaattgaaaaactatcattgaagaagtaactcattgacaatataatgatatagcatcttggaaacaatracatttagagatgtcataaaagaaaatgttcccttaataagtgttagaaaatattaataaaagaatctcaaggagtttgggacacagtgagggctaaatt

SEQ ID NO: 1702 - DNA, 201 bp, Homo sapiens; identical to SEQ ID NO: 971

SEQ ID NO: 1703 - DNA, 201 bp, Homo sapiens
gatcaagattaagaatcccaggtgtccagaaaaaacgtgatcattaattccaagggactggtgaagaaagaaagaactctaggtcaagagccagagagagyggtcaggaagcaaacgtgatcgacaatgatgaaatccaataaagcaagctgtaggaagaggagcctgaaattatgacataacaagtgaatggaacacaac

SEQ ID NO: 1704 - DNA, 201 bp, Homo sapiens
agaaatttgttgtattttacagttggacatcattgcattgtattgaaaacttatatttcataactagtacccttttagaggacatttaggttgtccctaarcttttccaactacaaataattatccaattaataaccttgtttaagaatcacatttggatgtgcaagtatattacagcaataaagtcccagaagtcaatga

SEQ ID NO: 1705 - DNA, 201 bp, Homo sapiens
tgatcgcttacacctggtgtaactggttaaatgtttactagcttggcaatgtgactaatcagcataaaagatccagctggaaagtttttcccggtctcatraaactcatattcttcattccatattggtggcttataatccacagactaagagtgttatatgagacaaatccctgcggagctgtgcccaggagtctctctg

SEQ ID NO: 1706 - DNA, 201 bp, Homo sapiens
ataagtactctagagacaaataaaacaggttaaagtgttggtgagtggtgaaagaagagggaacactatgtgctagggaaagacctatctgatagatgatkctcaaggagataattgaagggcatagagagccagccatttagcttgctggaggaaaagtggtccaagaaaaggaagagaaagggcaaaagcctcagaaca

SEQ ID NO: 1707 - DNA, 201 bp, Homo sapiens
aggacctgtcaaagatttcaagttgaaaacaccaaaagcaattgtaacagaagcaaaaattgacaaatgggatctaattaaactaaagagcttctgcaccrtaaaataaattatcacatagtaaacagagacaacccacagaatgggagaaaatttctgcaaactgtgcatctgacaatagtctaatatccagcatctata

SEQ ID NO: 1708 - DNA, 201 bp, Homo sapiens
cctattttgaatctaatagtcttaaatagtttagcaagaggcatttggtatgtgggtgcatacttttgcaatatttataagaaaatgttcagttttattcscgctaactttagagccaagcaaagaacatttatttctttattagaaaattctgaaacgtggggatatagtttggatatttgtccctgcctaaatctcatg

SEQ ID NO: 1709 - DNA, 201 bp, Homo sapiens
ttcttgttgctgtatcaccacattgctgctttttattgttgaaaaatattttcatgtattaatataccacatattcattctcctattcatgtacgccaagktttttttttacagtttaaagcaattcagaaaagagcagaatgatcgtaattataaaagccttttggttttcatttctttgggataaataacaacgataaa

SEQ ID NO: 1710 - DNA, 201 bp, Homo sapiens
atgttgaagtgcagtacccagtgttagaggtagggcctggtggaaggtgtttggatctaggagcagatccttcacgaatggcttgggctatccccttggtkatgagtaagctctcactctgaattcacaggagatctagtcatataaaagtctgtggcacctcgcccacttctgctcagtctccctcatttgctcctactt

SEQ ID NO: 1711 - DNA, 201 bp, Homo sapiens
aaggctatattcgtgtatggagagcccactcatcctttaagatccaccttcaatttgaaacttttacttgctctcccagttgagcatattctcaccttctytagaacaaaatttgtttgggatacaccactgagttttgcgtttataaaattcatcatcgtcttgtgaattactttcctacgtgaacattatttttgcaat

SEQ ID NO: 1712 - DNA, 201 bp, Homo sapiens
tgatcccagttctcaggactctccccatatgacttagtgatcttctgaaaactaatcaagttaaaataatttcatattttttcatgagcaaggagttccayaggggaaaatcctgagattcatttttccatttgtttcaattatttttataggctactgattctcttgactttccaaccaacagaatggaaagaagaaaaa

SEQ ID NO: 1713 - DNA, 201 bp, Homo sapiens
aaggaaaaaagcagagtccagaactcttgacaggtgaatgtcacagattgctctcaaggttctggcttgaacacctgagtgaatggttgacattatctgcrataacgctggcaaagggaccacttccagggagaggacagtgtgggacatgtaaaggttgagtgctggtggtattctggtaagggtttcatacctgttctc

SEQ ID NO: 1714 - DNA, 201 bp, Homo sapiens
acatggggtaaacactccctctgtggccaatgtgatgtggcagaagacggaagagatgtgcagtaacacaccattatgtcgcattcccaccacaaagatgsaaagccaaattccggataggagtactgcataggagttgtgggtagactgaagagcacagtaagtcacagttacaatggcaattttcagtaaataagcaaa

SEQ ID NO: 1715 - DNA, 201 bp, Homo sapiens
atttgtgacaccagatcacagtctaagtgagaccatgagtaaccaaggcggtaggagcatcagtctcaaaagatgtgcaaggagaggtgtggacaggggcmgtcctcaaagaaaaggcagtcacaatggatatacaggagatcagtcatcagatagcaggctcctagcaacccgttatggttcgaggccagggttcttgtc

SEQ ID NO: 1716 - DNA, 201 bp, Homo sapiens
attgcctcactgatgccaaatatttagagaaagtctatgaattaatctaacaatgccttcaataattgggtgattttttaagtctttaaagccgatgtggrtctttgatgttgatggccaccaattcataaaggttaccttccatgcaagaaaactttactagtttctgctgttgctaacatgcccaaggccccagcctaa

SEQ ID NO: 1717 - DNA, 201 bp, Homo sapiens
aatgggattgatgccctcataaaagaggcccaagggagtttatttgccccttcccacatgtaaggatgccgcaaaatggcaccatatatagatatgagccytcaccagacaccacgagtctccttgatcttggacttcccagacttcagaactgcgaaaaataaattgctcttgtttataagttactcagtctaaggtatt

SEQ ID NO: 1718 - DNA, 201 bp, Homo sapiens
tagccactaggatctaataggagattttaacctgtatcaacaagaaaatattcagataagatgaaagtttcaactaaccatatagtggtttcatatgaacrccaaatattaagaaacagatgatacgtgaatattttgttttctatgcaagtgttttgacactccgtcaaaatactattgtttttaagtctctagagaaca

SEQ ID NO: 1719 - DNA, 201 bp, Homo sapiens
ttccttcaggttcttcgtggctcctcctggcacagggtcgagccctgactcctccgaggcctctctcatctgggccctgcttccctgtgcaacctcctctstcatggcttctcgccctccctgttgttcccaccttcctgcagtgctgtcagggtacccaccttatgcctctgtgcatgctgagccccctggctggagcac

SEQ ID NO: 1720 - DNA, 201 bp, Homo sapiens
taataatttattttgtgtatatgataagatttctctttttttttgcatgagagtcttttagtaagaaacagtgcaaacatcagtgaacaatcagctcatcrtggaggatactaagatactaaattcatataatatcaagaaaccaactgaaaacggaataattaggtcaaaaatccaaattctgtcctcctgaggctctca

SEQ ID NO: 1721 - DNA, 201 bp, Homo sapiens
tttcagttttgcaggatgaaaggagtccttgaggtggatggtgggatggttgcacagcagtgtgaatatactcagccctactgaactgtgcacttcaaaayggttacgatggcaaactttgttatatgtgttttaccacaatttttaaaaaatgatggccaggcgcggtggctcacacctgtaatcccagcactttgggag

SEQ ID NO: 1722 - DNA, 201 bp, Homo sapiens; identical to SEQ ID NO: 636

SEQ ID NO: 1723 - DNA, 201 bp, Homo sapiens
aaaagagagttgttcttttcctccctgccctcctcctagttctcaaccaccaaggagctaaaacccttctagagaaccttccagagaactagaagaggagragcagaatcaatagaagggatcatattcttctctccaccgcaggttccttaagccatggcttaagatgagttctgcattggacctgagactggagtttta

SEQ ID NO: 1724 - DNA, 201 bp, Homo sapiens
aaatttaaaagtaaaatggggatttccatatgttcattttattattaaaaacgaattactaaaaagtgatgacctgtttggaattcatatcttgctttacsagcagtcagccagtatcgactgaacacaataaatgcaggggtgcgaaacgtgattgctcgggttcgagttctgtcggatgcaccgatctaagcagaacct

SEQ ID NO: 1725 - DNA, 201 bp, Homo sapiens
accaatattagaagtgtttcccagcacagcaagatgaacaccttccccataatgccttccacaatctgcctttctggaacaaggcattcttgtgtcctagyaattttcagatgttcccacttggaagacattctagagcacagacaatcttattactaatgaaaaaagaaagccagtatcctctctttttattctttcccc

SEQ ID NO: 1726 - DNA, 201 bp, Homo sapiens
attaaacctctctctgaccagtaaggaaattagatgttccggggcaattaattcaattagggatggtgctacgaggtcgctgctttaaatatgtaaattgycatttccatacagactaaatacagtgccatccagccctgggaaacgttcactcttatctccacaaaacaattgacatgttagtattcatgctagtcccag

SEQ ID NO: 1727 - DNA, 201 bp, Homo sapiens
gggaaggagatgggcaatacagaaacagattttacagccagaatatgacagggccccttaaactacaaatagatgtagaattttaaatgtagctctgtagytcaatttataccacagaaattgcgagatgctatcttcctgttgttataacgtatcaggtcaagggatataaattgtaccaggtaattcattttgctgttc

SEQ ID NO: 1728 - DNA, 201 bp, Homo sapiens
aaacttttccctcacagatctgtttgtatcttggaaacatttctgcaatgccgacgcctaggtttaaaatacaattagataatttgatattctcggtgacrcactgacaccgagaaagccaagagattctccaaacaaagtgaaattgaaccttcaaatgacattcttaagtttgcaagaatatctatatctccttgttgt

SEQ ID NO: 1729 - DNA, 201 bp, Homo sapiens
atttgcccaaggacaagggttctgagtggaagcagcttctacagcatcagtttcctttcttttttgaaagttggtgctgggtggaatcctagaggcccggmtacaacttgcttatactaggcccaagacccaacacatagatattttatcatgtacctgagaaacttacacgggagaaattctattctaaaactacaaatt

SEQ ID NO: 1730 - DNA, 201 bp, Homo sapiens
agtgcaagaattagagatagtgtatgttaagaggttagtccagtgagcccccaaatgtgagctattattactagactcattctactcaaggcagtggtgcrgtggggtgtagacagctaggtgggatggggtattctgagatgtcatcagcatgggctagggataaggaggacaggggtccccagcatccccagggacgtg

SEQ ID NO: 1731 - DNA, 201 bp, Homo sapiens
gcagtatattaagctctacaccccttccagttacgtcctggacatcaggatgcagttcagtttgcaccccgaattaaacagagcggataactagtgccacrtgcagcacacattgaaaaggtgggactcctgactaagcaggggactccagtgttctctcagagcctctcttaactcatcagtggtgtctgaagcagtagt

SEQ ID NO: 1732 - DNA, 201 bp, Homo sapiens
gccacagagaagagaagagcctcaggcacacactgtgtctggcctacaactccactttgggtcacccctgccagtaggagagtctatatatgaactataawgacatggaatatagtttaaacccatctttatgaacacgcaccctgtaaagatccaatctggtaattagagtgttagagtggtttatgcctttttagggga

SEQ ID NO: 1733 - DNA, 201 bp, Homo sapiens
gttcttgtgaagtgtatatccatgcgtatccagggctcagatggagagggcctcgcaatcacaatggtagtggaaatgaagaagagggaacacattagacrgggattggaagatagaattggcaggacatggttcctaaccgaatgtttaacgggatcaggaataggatttaaagctcacgcagctggcaagagtaggcct

SEQ ID NO: 1734 - DNA, 201 bp, Homo sapiens
agatcacttcgaaatcatgagcaagatctcccagacccaaatctcatggctagaaaatggatgacctgattacatagatcctaagatgtcttttataaaarcctgagaagaacagtggacctgagagtaaaacacttctgcagagataatttgtagatccacagtcaaaatatttcagctgtgcctttgtctgttgcccac

SEQ ID NO: 1735 - DNA, 201 bp, Homo sapiens
gactttcttttaggatctctatataaactataaaaaatagctccaaaattttgtgaggataatggcatacaaatgacttgctgtaattggtatttttaccycacaatgcaatgaagtccattgtacctgagataatggaactctctcgcattactgcagcattgttaccaagcaacaagaaataaaatgtcaagattaaca

SEQ ID NO: 1736 - DNA, 201 bp, Homo sapiens
agtagctcagaaagcaaagttccttattttccagctgtttaggcatttgtgtacccatccttgatttgcagggtctgaacaaattctattcctcaaaaccrgcccttaaaatctcacatgcccaccacttttgcagtagtttctggacctggagggagagttcttgtatagttttagcagcaggagatttgtagtgaaaaa

SEQ ID NO: 1737 - DNA, 201 bp, Homo sapiens
tgagttgaaaagtctccccgcaagatccatgtccttcccagaatctcagagtgtgaccttctttggaaataggattgtgtaattagttaagataaggtccyactggagtcgagtgtgtcctaattccaatacaactggtgtcctcttaagaagagaaggtacagtcggccgggcgcagtggctcaagcctgtaatcccagc

SEQ ID NO: 1738 - DNA, 201 bp, Homo sapiens
gcccaaagctcttatctctgaagcactgggagttaagttactaccttagaggagatgagcactttttaaaaattaaatgtggaaaaaaaaaaacgtggaayactcacaatgcaacatgacttatccttggcctccaaagccctcacacctagattattgaattaatttttcactagttcttcctactttccactttctccc

SEQ ID NO: 1739 - DNA, 201 bp, Homo sapiens
atgtaaggctctgtggggtgaacagtctggaaagaagaaagcagtgattcccagcaatggtcagaatccaaaagctgagaggccctaagaggaagaacagyggtgattttgcaccagcgatcatatgtctctgcgggaagggcagcatttaagagtctgtggaaagagggttttaacatctcctttccccaggagggatgt

SEQ ID NO: 1740 - DNA, 201 bp, Homo sapiens
ttgcttcaaggcagagatcacaaactttttctctaactgtgggtctcccagcattctccctcctgaacacggcctattaacggtagtgagctccggagggkaaaagggttagtcaacaattctgcttggctgcttcaggggagagccagtgttttgcagtctagtgaactaattatgcactcttgatgagatcattaaagg

SEQ ID NO: 1741 - DNA, 201 bp, Homo sapiens
tggcagtggttaggagcacggactccacctctttccgactgtacatccttggccaaggtatccaacctcacactcagtttccttcctacctcacactcagyttcctccctcagtttcctcatctacatcataagggtaacagtagttttggctgtgaggattaaatgggtttatatttacagaatgcttaaaacagtgctt

SEQ ID NO: 1742 - DNA, 201 bp, Homo sapiens
ttcttaaaatggggtctatgcctccttggattgttgagaaaatgacatgggatgatatttggcaagtgttcattaaatggtagcctttgttttcagcatcrtcactgtgatcagctgaattgctgattttcactttaactacaggaaacttgagtggaaaagtctgagtcatttatgtactcattacttcagcggatcaat

SEQ ID NO: 1743 - DNA, 201 bp, Homo sapiens
aggggcctggcagacctggggtaagtcccaccttagccccttagagcctggtgagcctgggcacctcctcccctctctggctggggtttcactttacctarataggtagggttgccagatatatcaaacataggatacccagttaactttgaatgtcaagtaatcaagaaataacttccgagtttatgtctcaaagtataa

SEQ ID NO: 1744 - DNA, 201 bp, Homo sapiens
ctttgaatgtcaagtaatcaagaaataacttccgagtttatgtctcaaagtataaatgctgcagtgtctgaggatgagctggtgttcgtgagggaaatgarggaaagcacgctggggcggaagtggcaggaccggtgcccctgggtctgcggtgctgaaatctgtgggtgacctgcagggagtgtggccaagcgccccaca

SEQ ID NO: 1745 - DNA, 201 bp, Homo sapiens
ctgccaattaacagcagcttttgggcttgacctcctctgaaggcattactaggtcctcctgttttcctcctacagcatccagtggaagtgccaatccagtmcagaccaccacgtggtccatgctaaacctcatgcaaaggcaggggcaatgtggatgggagagaagaagctttaaggggaagaagggcgttaaagttgact

SEQ ID NO: 1746 - DNA, 201 bp, Homo sapiens
ttcgaagacagtataaataggaagaatattgaaaagtgaaaattatcttaggctgttgaagaatatcttagcatgctgaaggactttggcaagtcatattrtaggtaacttccctcaattatggtaaacaactgattttctaaggccatttttaaaatacaagtaatttagtaaatatgagcccaagttttgtatcatagg

SEQ ID NO: 1747 - DNA, 201 bp, Homo sapiens
acccgtttttatcatttctgtgtgccgcttcccagcttttgtgtccttttacttctaaaagctgcagtggtgccgcttacggtgactgctccaacggtatkagagctgctttgcttatacagggaacctggggtttgtactcccatgatttggtccttagccaatggcagctccctcagaacaaaattctaggatgtaatt

SEQ ID NO: 1748 - DNA, 201 bp, Homo sapiens
atggagaaagcacgagtcaaaggtcaaatgcatccacctgcaggtcctgtcactgaccacttagcatcccacaatatcactgaacctcagtttgctcataygtaaaataaaattttaaaaaatagaaaatgtaggtagcgtgtctagctcagatggctctagtcccttactgtgacccaaccatttctaatttggcacaag

SEQ ID NO: 1749 - DNA, 201 bp, Homo sapiens
tgtaggccaaaccggctaagacaaactggatgcaccatggcactggatttgatataggacctcattatatgcttgtgaacatattgaatcacatacccacsagtgcggtaaagatacaagcccgaaaacctgcagcgtgactcactctcttgatattcaagtgcatgctaccctttactgagtgtgtacttttactttgct

SEQ ID NO: 1750 - DNA, 201 bp, Homo sapiens
ttgtggaaggtgctagagaataagggtccaaaaatgggagttggagaatcaggggaaggtcatcagccaggcctcctggagcactgacaccaatggacacrtcagaggtcccaggagaacttagaagccaagcatgcctaacaaccagagtgggcccctagccgagctggtggaggagtttatggaagttcttgccacttc

SEQ ID NO: 1751 - DNA, 201 bp, Homo sapiens
aaccatttctaatttggcacaagttacaataaaaaacaagcgtgatacttacctggcagggcaaataccatcatcacaaaggtggttttcccagggtaagscttatccattgcactctggatgtacaaactcctgcaatttccccaaatatgggaaactcgactgcatcatttgttgtcatggggactgcatttgcacttt

SEQ ID NO: 1752 - DNA, 201 bp, Homo sapiens
tacccaccagtgcggtaaagatacaagcccgaaaacctgcagcgtgactcactctcttgatattcaagtgcatgctaccctttactgagtgtgtacttttrctttgctataaatctcagttctttcactattttcaggcgtatcttgaattccttctcacctaagagcctggacaccagctaaggttgaggttgcactgac

SEQ ID NO: 1753 - DNA, 201 bp, Homo sapiens
ggtccctgaatatgaatgagagacttgctctcagcctgtggccaccctataatgttaaaacagtcagaagattaatacacatccactctgaggttcttgcrcagcacagagggagcccatgaaggtgataagagctgcaaagaggaagagggttcaaggcacagctggaagtgccatgcaccagccctggcaaaatccagg

SEQ ID NO: 1754 - DNA, 201 bp, Homo sapiens
actggcaggttcagtgtcttgcaaaggctcactctctgcttctaagatggtgccttgttgctgtatctcatagaggggacaaacactgggtcttcccatgrtggaagggccaaaaggggcctagctatttccctggagcccttttataagggcagtaatcccattcatgaggaccaaactctcatgacttaattacctcct

SEQ ID NO: 1755 - DNA, 201 bp, Homo sapiens
gagaaataacacaaggtagagaattcatgaatagataatcactttccgcagacaataagcaatgttccaataaaccctgagaaataactaattacttttcyaagtgagcaaacattattctgtagtcccgtagacctgaaaaggaatctaaagatagtgaatagcaatgtgttcctaattttcaaaagaagattaaaaggg

SEQ ID NO: 1756 - DNA, 201 bp, Homo sapiens
gactaacatgagttttcagaacctaaaacctggatgagcatgaatttcctccttatcatccagagctaatattcatgagcacaaaaagtggcattgatgarcaccgaagtttgtgggcagatgtagtatttactggaggcagggacaggcacaccttgtgcaacaggagcagaggcagagagggtgcagctcaaatcccct

SEQ ID NO: 1757 - DNA, 201 bp, Homo sapiens
aatagataccgtctacccctaaaatctgccatgtacagctcaggttgggcacagcacaccctgagaactgctggacctggatgtgcttgtagtcaagggtyttggaaggaacagccgtggtcatcagttcacacagccaggatacaggggatatgcccttatgtgacatagggcatatatgatatagagtatatgtccaca

SEQ ID NO: 1758 - DNA, 201 bp, Homo sapiens
gcaatgggaataaatttccccaagcagtgggaataaatctttccttgtttcaaggtgacattttttggacaacattgtagcattttggaagtgagggttcrttgtgcattagcgaaggttttctcctagtgacttccactgcctggtctactctaaggaaaaatccacttctgaaaggcaatcttcacacaaacaaaggag

SEQ ID NO: 1759 - DNA, 201 bp, Homo sapiens
agactaggcttattctagataatcttcctccaggagaaagaatgctaactgataactgggtgtttgttgtcaaaaatggtgattacacttatgggttaatrgtagaagatggataagcagagcctgttattcattcttctggacctgttatttgtgttggggagaaaatcaactaaataaggtaataatgccagatattta

SEQ ID NO: 1760 - DNA, 201 bp, Homo sapiens
atttttccatgttgttcagagtacctggagttcattcattctcactgctgtatagtaccccacattctataagttacacctcaattagtttactccctatyttttggatggcatgtaggggtttcacagtttggggctaggagcattctagtacacaggtctggtgaatatgtacacatttggtcaggtatatgcctagga

SEQ ID NO: 1761 - DNA, 201 bp, Homo sapiens
agtttactccctatcttttggatggcatgtaggggtttcacagtttggggctaggagcattctagtacacaggtctggtgaatatgtacacatttggtcargtatatgcctaggaaaagaatttccaggccatagcttaagcttaactttagaagatacagccaaacagttttccagtttagttggaattacttgcacgct

SEQ ID NO: 1762 - DNA, 201 bp, Homo sapiens
atgattgtcaagctgtactcagaaacccaggggccaccaggtagtgttgaagaggctctagaaaaaagaggaagtatttcagattctgaggaattcagtcrtcagtgttatttgtcttatagagagtatgatttttttttaaatcctatttctataaggaacaacataatcaacagagaacaaagaaacaggttgaaccct

SEQ ID NO: 1763 - DNA, 201 bp, Homo sapiens
cagagcctccaaagggatgagatgcaggtcagtgctgcatagggaggggaagggggccccttctctgagacgctggggctggagccaccccagaggagacwtgaccccaggctcagggaccagaggatttctgggctccagtctatcaggaagtgacttagcctcgcctgtaaaacggtgataatgaggggtcactatgat

SEQ ID NO: 1764 - DNA, 201 bp, Homo sapiens
aggattcataacttcatcctaggagcaaagggaagcttcagggtggcagggagggggaataacatgcctagatttggcatttttcaaagatttgcctgctraagagacagattgggagtgaacaagaaaggaggcagggagagcagatgggggcttttctaggagaaagattatttgccaaagagctgttatggttaaaag

SEQ ID NO: 1765 - DNA, 201 bp, Homo sapiens
gcctagctgagcccagcccagagcacctagctgccagctgaactgtggactcgtaagctatctaaacacctgctgttatatgctgctgacatattatggcygtttttgtgtagtaactgttacagctgcccatgctagacccccttctccatcctcctacagtacttgaggtgtaccccagtctggagagaatattggctt

SEQ ID NO: 1766 - DNA, 201 bp, Homo sapiens
gtggccagtgtaaatggggctgcctgtagggtggctgtgaagactgaataggataatatgtgaagtacttaacaagtccctggcatgtagtaagtgctatrgaaatgcttgctgtgatagtcaacctttgttttctgcacttcttcctctaacgggttatggtttagatgtgagccatagttgttctgtctcgatttctgc

SEQ ID NO: 1767 - DNA, 201 bp, Homo sapiens
cataattacatatcttaagatagaataacgccttcaggaagaggggaggtagaatatgacatgcataaaatttatttctaagtaaatgggcatagtaaagyaattatcagaattaggccctgtaactaaaaatctaaatagaaaaaaaatcaagcagaacatttaagaactttatagctaatttgtcactaaagcattatt

SEQ ID NO: 1768 - DNA, 201 bp, Homo sapiens
tttataagcagctagtgtttaagagaaaaaaatacagactcgaacaaatgttcagaaataaagaaaattcaaaatattaaccactttagatagctgtactwaaattcaggaaaaagtggcatctctccacctctgtaatatcatctcacaacctgattctattgtgcctccagaacaaccttttcaataaatgactttact

SEQ ID NO: 1769 - DNA, 201 bp, Homo sapiens
aaatggtaaaaagcaagttttgtgcatcaaaacactaaataggctgaatagaatttaaaaattaaagttggtatcaaaggggttgagagaatgccttcttyactagagctgaactaagtgtctggatcactgctgttgcctctactggtctagctaaccacatatgtagccactgaaagctagatatccatataatttaac

SEQ ID NO: 1770 - DNA, 201 bp, Homo sapiens
aagtaattgccattcaacattctggctttctgcctgagggcgttttcctgctttagagaaggcaggtgctacccaatgagagcaacgctttgaaacagaaytgaatggagctccaaacttctgaagtggttggaaagtataaagcacaggggctgtgctggggggttggaaggaagatggttaggaagcagtgaccaaaag

SEQ ID NO: 1771 - DNA, 201 bp, Homo sapiens
tgatggagttagaaaatcagtggatgctaaagctggtcaataggttgttgatgaacacagtatttacacagtctcaaagtatctgcccatatgatacttaytaattacaatgggaaaaactattggagaaacctggtagatatcactttaaaaaagttatcaaatttaacatcatcaatacttacatcacataaatatgcc

SEQ ID NO: 1772 - DNA, 201 bp, Homo sapiens
ggtagatatcactttaaaaaagttatcaaatttaacatcatcaatacttacatcacataaatatgcctccttataagatacactacgaaggtgtgtggtayaattaaacatgtttctgatctttgttcccagttcctgacacagacctcctaaaggccatgggatttcttgagtgatactagtgtatttccatatttgcaa

SEQ ID NO: 1773 - DNA, 201 bp, Homo sapiens; identical to SEQ ID NO: 1510

SEQ ID NO: 1774 - DNA, 201 bp, Homo sapiens
gtttcgtgggtctaccccccaaatttcagattttgtagatctagactggggcctgtatttctaaaagttctcagatgattacaaatgctgctggtccaggsacaaaagacgcattgacaactactgatacagaattactaaatgttaatatttggtgatgtttcctttattaatactattaaattaagataaaattaaatt

SEQ ID NO: 1775 - DNA, 201 bp, Homo sapiens; identical to SEQ ID NO: 1512

SEQ ID NO: 1776 - DNA, 201 bp, Homo sapiens
atcttcataatatatactttgttatttaaagggcagtgtgcagaaggaaaaagaaaggattgtcactatcacaacctcaagtccagaacaaacagaaactytgcgcagcacttttgtttctaaaacaaaactacaagaaagaatactgtggggaataaatgcagtgaacgatttgtaacttttcctttttttttttttttt

SEQ ID NO: 1777 - DNA, 201 bp, Homo sapiens; identical to SEQ ID NO: 1513

SEQ ID NO: 1778 - DNA, 201 bp, Homo sapiens
ataagcatttaacaacaaggaatacagggtatttaacacttgataaagcactttacctatggaatcttagacattaatggatgagtatagatgtttgtacrtatctattgagagcagcaatttcattaacaatcaccttaactcttcaagaatacatgaaaacatgaaaattattttatagtcaaaattcaccccagggtg

SEQ ID NO: 1779 - DNA, 201 bp, Homo sapiens
attacctccacctggtcccgcccttgatacgtagggattatggggattataatttaaggtgagattttgggtggggacacagacaaatcatgtcagtacgygaattatatctcaatatagctgtgtttttttaattttttatttaatttaaatcatcctcaccggcagtcataatatggaagaatgtatatcctgaggata

SEQ ID NO: 1780 - DNA, 201 bp, Homo sapiens
gcacattttcatcaaagggaatggaacaatttcaaaattataactctaagaaacaaagacaatccaaagtggctgctaaaagctggtttcttggacttagrttataagtctcgtaacaagttttcacagccaagaaccacttatgcaacattaaaaaaaatcctatgtatcaaggaaaagtgaataataatgcagtatcaa

SEQ ID NO: 1781 - DNA, 201 bp, Homo sapiens; identical to SEQ ID NO: 1514

SEQ ID NO: 1782 - DNA, 201 bp, Homo sapiens
agtttaaattatacacatatatacacaatctcattgagtcagattgtaaacaatcctttaatcttttgaatttccccttttacaaggcacattatacacayccaataatcataaaggacttctgaggtgttaaatttctaagtatgaattaaagaaacaaaggtaaagtttaattttccattacactttagattgggaaga

SEQ ID NO: 1783 - DNA, 201 bp, Homo sapiens; identical to SEQ ID NO: 1515

SEQ ID NO: 1784 - DNA, 201 bp, Homo sapiens; identical to SEQ ID NO: 1516

SEQ ID NO: 1785 - DNA, 201 bp, Homo sapiens
atgtatatttatatgttattttcctagctctgtctgctaatataccagcaacaataagcacatctagtgccttaatcttggtttcttaataccattccccycactaaaagaaaccagggctccttgggaaaaaagaatgattctagggctagggcacggaaagtgtaagataggcctcaaacattctgattagccagaaag

SEQ ID NO: 1786 - DNA, 201 bp, Homo sapiens
ttagaatgtgggaaaagcatatgtgtgcataggaagacactttgtgaatggtaaaatagcatatataacactttacattgaataacaatagtcgaggattygattcatcaagaaaagtcctagtagaacaaattatgtttcagatactgttcaatttttccttgttcgcaaaaccaaaaacaaaactgagaattagagagg

SEQ ID NO: 1787 - DNA, 201 bp, Homo sapiens
ctaagatcacccagataccaaaatctctcacctcaggtttttattttgtcccagggcaggaaaggaaaattactgtgttcccactaatgcttagttccttktttcttaaccctggttagtcacagttgctgctgaatcatccagatacaaatcacaaagcctttccctccaaaattcatagggtatcttcccaaaggtcca

SEQ ID NO: 1788 - DNA, 201 bp, Homo sapiens
aataataataataataaaataaaataaggtaatatatgtaacgcacttagcagggtgcctggcaaacagcaagtgctcaataaatgagagctcttaataaygaaagtgtcctgtcccaggccgccctacagaagctgaaggcagaggagtatgttcaacagaagagggagctcctgaccctctatcgggaccaggacaggg

SEQ ID NO: 1789 - DNA, 201 bp, Homo sapiens; identical to SEQ ID NO: 894

SEQ ID NO: 1790 - DNA, 201 bp, Homo sapiens
gtttactatttcttctgtacctactcagagttcctaaactgagtgtatgcagtaggtggtcaacaatattcattagtaaattctttgtattcttcctgagrgcaaaactgctaaaactccctggagaaaaaggcaatacctggcaaacataaggcatctctccaggcttatgagtatccttcatatgctggagaaatagtg

SEQ ID NO: 1791 - DNA, 201 bp, Homo sapiens
ggaaaccctgaagataaactgtgtttactatttcttctgtacctactcagagttcctaaactgagtgtatgcagtaggtggtcaacaatattcattagtarattctttgtattcttcctgagggcaaaactgctaaaactccctggagaaaaaggcaatacctggcaaacataaggcatctctccaggcttatgagtatcc

SEQ ID NO: 1792 - DNA, 201 bp, Homo sapiens
acacttgtggaactccaactgtcggcttaacaaactgggtacctggggctttaaaagagagacaaagtaccagatcttggtcagtgagctcacctataacmcattctccctgcctttactggaaagattatttccccaaactgatggatgatcatcagaggtttccaagaggagtatagattctaaagactaagaaagcac

SEQ ID NO: 1793 - DNA, 201 bp, Homo sapiens; identical to SEQ ID NO: 895

SEQ ID NO: 1794 - DNA, 201 bp, Homo sapiens; identical to SEQ ID NO: 896

SEQ ID NO: 1795 - DNA, 201 bp, Homo sapiens
cttaaatcattaatatttttatatttttagattttctttaaatgtacttactaaatgacttaggatatttagaacaataaaaacaaatcttctggatgccrgtttattccaaatggatagacatttttccttacctggaactagtgtaattggtctaaccgtttggccttgctgtacgttcagcacaatcccaacctgatt

SEQ ID NO: 1796 - DNA, 201 bp, Homo sapiens; identical to SEQ ID NO: 897

SEQ ID NO: 1797 - DNA, 201 bp, Homo sapiens; identical to SEQ ID NO: 898

SEQ ID NO: 1798 - DNA, 201 bp, Homo sapiens
cttaatctggggtctatggaacaggcctctaggaatccaggctttctctgaaattatttgcaaaagagtaaaatgtagatttttctaggaagaggattcamacatttcatatttattctcaaagaggtctgcaactccatttagaaacactgtctacaggtacattaggtgctatgaggacatggataaataagaaattct

SEQ ID NO: 1799 - DNA, 201 bp, Homo sapiens
gaaaatgaattgattctccatggtggctgtcctaactgtccctctgagcaccatcaccctccttaacacctaacacaatctcctactttgaggaaataggyatgaacaactgtaacttctgctgcttgttttccaaattatggaaggatagatctcttgtaccttcctaaggctcatccaacctcatcatgccatgtattc

SEQ ID NO: 1800 - DNA, 201 bp, Homo sapiens
attaaatataatgatccactgatattctggggacaactcagaaaatttttaaataaagtaggtattgaatgttattaaggatttctgattaattctgttasatcttttttttttttttgagacggagtcttgctctgtcgccagggtggagtgcaatggtgcgatctcagctcactgcaaccttcgcctcccgggttcaag

SEQ ID NO: 1801 - DNA, 201 bp, Homo sapiens
tgaacaaaataaaagtcaggcttgtaaaaaaaaacaaggtgaatgaagtaaagaactggctacaaatatgaaaagtacttcctctacactgttacccacaygtaaataaatataatgggctccccccagcgccattcaatgagtgaacagcaaggtatattccccttgagtttaagagtttccaaacttactagtagattc

SEQ ID NO: 1802 - DNA, 201 bp, Homo sapiens
ctggcggtaacagtgctggcagatagtgtgaccatctacctcaccgttctgctgatcgagttctacgtggtgtttcatatggttcatgaatctgtaataamgcacaaagagaaagtacagaaaacataaaaaattggtagccttttagaaatataatggtaaaatcacagaacaaacattatctgctcccctccattcccc

SEQ ID NO: 1803 - DNA, 201 bp, Homo sapiens
atgcaccccgaagttgagaacgattgtgctaacagttcgaattcagagttcaagctctcagaccctgagcaatagtgtctcaaaattaatcgtttgccaasgagcagccctccctgccccctccgtttccctttcctctagttgggtaaatgcctacagaagtaaaacccggccgggcgcggtggctgacgcctgtaatcc

SEQ ID NO: 1804 - DNA, 201 bp, Homo sapiens
tgttaaaattaattttgcctgtttttttaaactttacagtagacgccctttgccaatgggaaatatacgttccaagacccccagtgcatacatgaaacctsagatagtattgaaccctatacataccgtgttttttcatatatatatatatatatacctatgataaagtttaatttataaattaggcaaagagattaacaa

SEQ ID NO: 1805 - DNA, 201 bp, Homo sapiens
tttaactaggtaaaacctattttattagaagataatttgttagctaatcccccttaattttttaaaaagaatattcatcaacaaacattaattcagcaagyacacagaatctaaggaatggtttctcttcctagtgagttaaatctgagaaatgcaagattctttaagcaaccactgggaacccagagactgacaggctac

SEQ ID NO: 1806 - DNA, 201 bp, Homo sapiens
tgacaattcaagtgtcttacaaggttctatttccagaggatgaaacaggcaatcacaattctggtgctttaaaaaaaaagcctttaaaaggattatccaamctagggcagtggtatgcacccgtagtcccagctatttgagaggctgaagcaggtggatcacttgagcctaggagttcgagtccagcctggacaacacagt

SEQ ID NO: 1807 - DNA, 201 bp, Homo sapiens
ctcaaacttctgacctcaggcgatctgcccgcctcaagcctcccaaagtgctaggattataggcgtgagccactgcgcccagccttccttcattcttttargtttacttccatacccttaaagcccagaaatagagggctaaatacaataggaactgaaaaccataattagttatactgtaagaaatttataacattaaat

SEQ ID NO: 1808 - DNA, 201 bp, Homo sapiens
caactgttcatgtgatttctcctcctacttaacccttagtccaccatttaaacacaatcccttcttcgtctcacatctcctggttaattaagttacatcayggagcccactgaactgggattttaatctttgcttacatagcactagcaaacctctaggactcaaaggtttattattaccactagtggtattcataatcat

SEQ ID NO: 1809 - DNA, 201 bp, Homo sapiens
ggatagagcctgatattagttacattgcagggttgttatattagagatataatatataaaatgtctaggccaatactttacagtagttactccataaatgrtagtttttaccaataattcttaagatataaatattttatgggacatgataacatttgactatactcatggatgacaggctccctattctgattcttcccg

SEQ ID NO: 1810 - DNA, 201 bp, Homo sapiens; identical to SEQ ID NO: 899

SEQ ID NO: 1811 - DNA, 201 bp, Homo sapiens
ctggacaatgtctaacctccccccgcccccagccccctacaccccagccaaagaaatatgaataaagttgaaataattcttttttctttttttaactacckagaaccctggatttttgttttgagacagagtctcgttctgtctcgcacgctagagcgcagtggctcaatcatggctcactgcaaccctgacctcccaagc

SEQ ID NO: 1812 - DNA, 201 bp, Homo sapiens
actgcactccagcctgggcaacagagcaagactccatctcaaaacaaacaaacaaacaaacaaagaccttcaggctttcatataacctatatgggtggatraaattttagaaataaataataaggggaaaaaagataaataaaaattcaaattttaaaataaagtaaaatagatccatgggggtatctgatgacatgatat

SEQ ID NO: 1813 - DNA, 201 bp, Homo sapiens
caccacgctaggccaaatagtagtttcttaaaggacagttaacattttggaatctgaaaccacatcaatccacttttttactgttaaaatccattgctatrtctggaattttcaaaggatcttttgcctttgcttgattttgcaacatcatgcattggtcatttgcaaagcctagatttactgagttatgcccatcttcca

SEQ ID NO: 1814 - DNA, 201 bp, Homo sapiens
gtaacagaactgatagctttggtctctcttttggaccatctggataatggtttgaaccatcttgatgatgatgggaaacccaagtagtagaacaaataacytgaatcagatccttagaaatcaactcgtatgtgcctctgtaacatactggggaggaatctgaaagccaatccagtctgatatgttgaagaaatttgatcc

SEQ ID NO: 1815 - DNA, 201 bp, Homo sapiens
aaacccgtaaataccattataaagaattttaacagcattttctgcaaatattttctcttatatcagggtcaagtttaaattttggtggattgttagaattyttccaaaaaggctgggcaaggtggctcatgcctgtaatcccagcattttgggaggctgaggtgggtggatcacctgaagtcaggagtttgagaccagcct

SEQ ID NO: 1816 - DNA, 201 bp, Homo sapiens
ctatcagaatacaaattgtggttttcaatgtcatgcctgtggttattttaatagcatacccaaaagggtgttcttttatcttaagtatttacaataccttmagagtttcagttctttattttataaagcaatgaattttaataagaatattgaaatttcttccatttgaccttctgagagaaatggaaagaactccagctt

SEQ ID NO: 1817 - DNA, 201 bp, Homo sapiens
tatacaactcccccactgctaaatttgactggcttaaaaaaaaaagaaatacacaggaaagcaatataatacagtggaaatcccgaaagctttgaagtccmgaaaatgcaaatacagtttagtcacttagcaactattattacttataacaaaagcaaattatttagactctctaggcctcagtttccacatctgtaaaat

SEQ ID NO: 1818 - DNA, 201 bp, Homo sapiens
ttttatttaggaatattatttgctaccttcttatgtttagaagagttggggactttcctagagacacaggaggtgagaaaaagcctgaggaagttctcagmctgggtttctaaaggaagaattcccattagctttcagtaagaagcaattaagatctctgtcttcaaaatatatttcataagaaatgcatgagcagcagtg

SEQ ID NO: 1819 - DNA, 201 bp, Homo sapiens
catctgcctctttgcacaattaagactttcctctagggtggtagacacctccctcgtgaatattgaagtgctgatttcactggaccagctcagattgtatratactcagttccacatttagcaatcagatctactttttcaaactgccaagcctctgggtggcctattgcagaccagtctgatttcagtcttccatttgca

SEQ ID NO: 1820 - DNA, 201 bp, Homo sapiens
tgatctggttctcctcatggtagttttgaaatcttgtggtttcctgttttgatgattggttttgtacatataatcagtgaaactatcctcacaaattacaygcatcccttatttcatttagaagttggtaagatgtttttccaaccttttaagtgtattcttttttttctgtcctctttagtcccaggtaaaccaccacag

SEQ ID NO: 1821 - DNA, 201 bp, Homo sapiens
tgcttttcctgagagattgagaaaggcaagatttagttttactcttgagagaaagctgatactgtgtctgaaatgtcaagatgcctgaaaacattcactcwgtcaggcagctgaacgcaggagctcctacatcccactgtgtttaaccactcttctcagcattgacaaaatacaaaggatggtacgggcattgttcctggc

SEQ ID NO: 1822 - DNA, 201 bp, Homo sapiens
ttcctgtgtccttggcattgggtgggcctgcaggcaaatattcctccttccccttcttcctcagcctctcctcacactgcaatcagcacccatagctctgmaggtgactgtccctgttccaccttattcattcctggtccagcccagtggtgcccatggacttaagcagcagctcaggtcccccgtgtctgagtccactct

SEQ ID NO: 1823 - DNA, 201 bp, Homo sapiens
taatacaagaaaattctaaactcagtaggtttttgggaaatagaactctttgtggaaatattagtacagagcaataaattactgaggaaatatcattaatrtaattttttcttattaaataaagaattatccttcaggacgcggaaagaaaccttggaggtctgaaatctaacatgattgttttactgactgtatcatttg

SEQ ID NO: 1824 - DNA, 201 bp, Homo sapiens
ccctggctttttttttttttttttttttttgcgtatgattgttttggctatttgggctctgttttaattccaaataacttttagattagatttttctaatkttgtgaaaaatgatgttggttcgatagggatagtgttgcatctataaattgcttttggaagtatggccattttagctatattgtatcttctaacccatga

SEQ ID NO: 1825 - DNA, 201 bp, Homo sapiens
ccctggagtcccttctctctccacagcaaatcaaccaggaaatcaattcaccattcatacatgcatgttatcacacacacacagacacacagacatgcacrcacagtctctctcacacacactcacaccacacaggtgtttacacattcacacacacacacatacacaaatgcatgcagaaatacagacacagacacgcac

SEQ ID NO: 1826 - DNA, 201 bp, Homo sapiens
ttttaggaaaacatcatctgaagccttaatattgatgagatattgacatctatgttgctcctgggccccagtggctcttgtttctgaagaattgggactayggtcaaacagtgaaaagtaaaatattggccgggcgcggtggctcacgcctgtaatcccagcactttgggaggccgaggcgggtggatcatgaggtcagga

SEQ ID NO: 1827 - DNA, 201 bp, Homo sapiens
ctagtcattcttaatatcagcttttgatggaagaggagagatgaagaaaggttcagaaaggagcctccaaacctcagcgacaggctctgctgcattcacasttctgtcgagaacccgcagcttctccattttgtcccaggtaggtgcaagagtgtgagggagcaaatcctccctagtgcctattcttctccgggacaaata

SEQ ID NO: 1828 - DNA, 201 bp, Homo sapiens
ctgatggatggattggtgcaaggctggtcacgaaggaagccgtctcaccctctgtaatggaacgtgctcatctgtctagcagagggtgagaaggagaccaygtgtgctgttgattccattatgctgctcagggtaacctctgccgctggtgagaggaggcaaaaatcaagagaccttgacctgaatcatagtggaaactta

SEQ ID NO: 1829 - DNA, 201 bp, Homo sapiens
ctggagagatgcgttctggccgtggctgtgagcgaagcaccaccggttgcagtccctttacccaggagctggggagaggctgaggacccagaatgtcttgygtatcaggcagtagaaactcacatgaaaaacacatgaggctttttttgttttgtttttttgcagtgagtaaaaaagcccaatgcgttttttatttgaatc

SEQ ID NO: 1830 - DNA, 201 bp, Homo sapiens
tagccaactaccataaatattggctgcctgtcagaaatgatgtacccgaatttcacgtttttcatttcctcatggtaacccagcccacacaatatttttayataatgacagctgtcaggaaagcagaatatcttatatatacattgtattttgattaatgagctaatgatggttctctgtttaaagtaattagcccccaat

SEQ ID NO: 1831 - DNA, 201 bp, Homo sapiens
gagcctgtctaaaaaagaaaaaacaaacaaacaaaaaagatgaagcaagtaggcattcctctttcctcaggttagggttcttttcaaaggtgcttttcagrtgggcaaatatcaaagatgagccagcctccccctaagcctgtggactccactgtgaggggagtcggctgttccttatgacaccattgtgcagttgtgcct

SEQ ID NO: 1832 - DNA, 201 bp, Homo sapiens
ccatcccgctgacctcatttcccgcatccctgcctctccatggcctgctctagctacctggagctcctggctgtttctggagcacacagaagtgcccctgkaattctcccagcatcccacatgactggctccttccccctgggtctgtgcttacatgctccctgctctgaccgtccctgaccacccgattgaaaatgtcat

SEQ ID NO: 1833 - DNA, 201 bp, Homo sapiens
taaaattatctttacttcttgccagccagttcctcgtaccccgaccctattgtccttactgattatttatataaaactttccctgttcaaatcactctgtrgtttctctctcctgattggacccagactgatgcactgttcccagcagcaagtagcactatgtgccaagcaccaggtgataatttcagagagctgaagtga

SEQ ID NO: 1834 - DNA, 201 bp, Homo sapiens
aaaacacagacatacattcttgcagttctggaggccagaagtccaaattagtttcactaggctaaaatcaaggtgttgacagggctttgctctttccagtrgttctcaggaaaacccagctcgtttccttgccttttctggcttctagagctgcatttcttggacgccttggctcatgtccccttcctccattttcaaggc

SEQ ID NO: 1835 - DNA, 201 bp, Homo sapiens
tggctgccggctaatgaaacagtggtacttttagcagaatttggaggtaagcttgccttggtcataactaaccaattgtaatcaagttttggaggggatcygtagccccctatttgcctctgatcatggtggtttagcatacaagatatttcctaaatgaacccgatcgctgttgcctgcgcatattgccattggtcagtt

SEQ ID NO: 1836 - DNA, 201 bp, Homo sapiens
ccaagctatatcagcttctcattggctttttatgcactgaggtgagagccaagtgtggagaaagctggtgaaagagtttccacccaaagatttgagtttgrtcagaagacaaaatgagttcaatgaaattttgaccaatctatttcatttttcttccctaagttatagaggtgacttatacttttcaacaaacagattttg

SEQ ID NO: 1837 - DNA, 201 bp, Homo sapiens
tcaggtttagcatcaaatgctttacttaagagatgtaacttattaaatgaattcaaactgatctgaataaggattggcacatttaaaaactggctgaagcrtgactaatgagtgagttaaggcagaatgaccaaacagaagagaaaagctgaggtctgcacaccttgccttatcctgattcctaattaatgttctggacaa

SEQ ID NO: 1838 - DNA, 201 bp, Homo sapiens
catgcatgtatgtgctgccacaggttctttgcacttgccatatccctgccaatctatttttaaccctggtatgcatttgatttacttccatctctttcagrtctttatgaaaaagtcaccttttacttgaggctttccatttccatcctatttaaaattgtacctcccaatttgctattctatatgctacttaatttttcc

SEQ ID NO: 1839 - DNA, 201 bp, Homo sapiens
caaaaaattagatagttgtgatatatgtgtgtgtacatatatacatatgcttgtatgtttaaaaagtttctggaaggatacataagactctgtgaatggtmgttaccactagaacaggcaagggagggactcacactcttgactctgctgaattatttgcatgtttttcaccttgggcaggcattatactaaaattcttca

SEQ ID NO: 1840 - DNA, 201 bp, Homo sapiens
tcccttctgcatttcagatgaagatttttgacagaaataaagatggtcggttggatctaaatgacttagcaaggtgagttacatggaaatgatatcatacmttcagaaataccttactaggggtctgatgacatcatatatttccttttgagactggagatcaagcctcacctggagtctaaaagaataggcacatcttac

SEQ ID NO: 1841 - DNA, 201 bp, Homo sapiens
aaagaaagagaaataagttttcctgtattaggctgacttgtcccagaggcagcaacaggcacagtccagacccaggaaaagtcttgataatattatctaaygttctctggagactttcccagcactccctcaacaaagggagaagaaaaacaaattttcctttattttatgaaatgagtttatagatccctgttctctata

SEQ ID NO: 1842 - DNA, 201 bp, Homo sapiens
aaaaatcctgttttgcctgtcagagactgtggtagtcgttgctgctatcctccaaataattagttttcctcttaagcacatggcaggattgtattattctrtccctttgaaggtagctgtggccagggatctgctttggacaataaaattttaatcagtaaattatttattattctttctttctgccatggcaatcaggaa

SEQ ID NO: 1843 - DNA, 201 bp, Homo sapiens
caaaaaagagaaagacattctgagcaaatagtcagagttgaaattattggatctggaatacacagatatacctgttattggggagcatccataataccagstgcttcagggcagggctcaatggtaattgtaagcagggcagcagttacaggctgcagcgcagcagcaggtatagctgagagagaggaattccaaggactg

SEQ ID NO: 1844 - DNA, 201 bp, Homo sapiens
acatttttggtgccaaagtggtgagaataggttttcaaattcatttgaaatattaaaaataaactggatttggagacagaggaaggatgggggactaatgyattttttaaagcaaaaatctgttggatgtattttcagattatctcgctccctctttttccctgtgcagcctccttatatggatatgcttagagatattct

SEQ ID NO: 1845 - DNA, 201 bp, Homo sapiens
ccaaagctagcatgcttcccgccataccctatggcccaccattgagggagggtattttggacaacaggaagaatgtgggtctcctgatgacccctgaaggytgacagagataaagcagagagattagagaccctacagtaaggggccatgattccagttcaggaatcctccctcccctgtcttagcagacaggcataagct

SEQ ID NO: 1846 - DNA, 201 bp, Homo sapiens; identical to SEQ ID NO: 736

SEQ ID NO: 1847 - DNA, 201 bp, Homo sapiens; identical to SEQ ID NO: 737

SEQ ID NO: 1848 - DNA, 201 bp, Homo sapiens
aggacagtgaggatgaggaaggccaggaaagggactgggatttttccaccagaaaagagaaggctcaatgggtccaggatagtcatgacaagaccctgcayggggccatcatgagaaagcgatgtgcacacaccagagaacaatggcggtcctgtgggcggccggagattttggttctgtgcagaaggaatgtcccgacct

SEQ ID NO: 1849 - DNA, 201 bp, Homo sapiens
tggctgagagaagctccatctcaaaaaaaaaataacaaaaatgcatatccaatgaaatcactgttctagaaaagtaattagatgaatgtaattgtacatayttcagttgtaggacaagtagaatccactatgtaaagactgaatgaataaattacgatagcaaaacactgtatgataaaatactacagggccactctgcag

SEQ ID NO: 1850 - DNA, 201 bp, Homo sapiens
tcagtgtttacataggtttgtgaaaccacccaatttctccagtaaatatttaattctctttgctactgatcaaaccataagcaacacaacatttttatacracatgtttggtaatgagaaaatgagacattgacgtcaacagcacaaagtctataaaccaaaaacaccaggatttcccgatacataggcctcttggaaatc

SEQ ID NO: 1851 - DNA, 201 bp, Homo sapiens
tgtgatttggtgtaaaatttcctccattaactcattcctacagattagtcataggatacaaaaaagcatatgtgcctatcaaaagcctgaaaagtctactractatttggcccagcaattctctacttctgaggctctagaggcaattttacaaacacacaaatttatatcagggattggagcagagtttctatgttagag

SEQ ID NO: 1852 - DNA, 201 bp, Homo sapiens
gtatttattacagcagccctagcaaactacagcagcccttcagaagcctctctatatcatgacgtggaaatgtaggaacaattactcagtgtttctattasctactcttttttgtttgtttccttatacatttcttcttttttctttcttttactttccttaccacttctcttttaccctacactttagctccaggtagaa

SEQ ID NO: 1853 - DNA, 201 bp, Homo sapiens
aattaaatatgtatgcacactgtcacaatggcacctcttgacactggctatctgacttgaaatgtcaatgttgagaggagaaagctcatggtcagtgaaaytgcaggaaacagaagcacatttggatatgtccacctcactagaattcctaccatagggaaaaatgaagataggctgaaaatttacttagtttttcagttt

SEQ ID NO: 1854 - DNA, 201 bp, Homo sapiens
aaggagtatgactaccaacaaaaaacccttaaaagtatttaataaaaaaactcttcctttgaggagaaagaataaaagatgcaaagagctttgaaatggayctttcccaggtttttacagaatctttgggtcggctgcatgcggcctattccccactgtttcttagtatacgataacaggcagttatggtgccatttatag

SEQ ID NO: 1855 - DNA, 201 bp, Homo sapiens
tgtttattgcttgtgctactaaaaactaataaatataggttaaaaatagacatttaaatagagtctctctgggaaggagtgaacggctgaatttcagcttwttcctggtccttttggttaattcagcattcataattatgttagacaaatccttggatgaaaagcatcctatatactacacacagagcaggtgcatctcga

SEQ ID NO: 1856 - DNA, 201 bp, Homo sapiens
tttatggaggtgccccgggcttagttttcctactttgtatctgatatcctgctgtattttaagttcaaagaaagaaatttattctaattaaaggagagaaraaaatggaggtttatttttcagggaacacaaaacagtgaagtgaaaggatacaaaccagcagcgcagcactatttgatctgctttccaaactgtaattgg

SEQ ID NO: 1857 - DNA, 201 bp, Homo sapiens
catttaagattgttactgtgtttctccatcattatttgtttagtcaacatgctaggtcctaaggttacattataggtttttaaaaacaaaaattaattttsccctctgaaattaccttcatgatcaattaatgcaaaatgtgtgtgtgagtgtgtgtgtgtgtgtgtgtgagagcgagagagagagagagaacgtgtgttc

SEQ ID NO: 1858 - DNA, 201 bp, Homo sapiens
ttataaggaaacttcgttgtcagctggattatactggtgtgattctaagtgtatggatctagacaatacaccgaagatgcccaaaatgtgcctttccccartggatatctacctagttagttactcactccagagacacttttttgaaggggctgctttgtgtattatcagttcacaaaaatatgaacactattaaaagta

SEQ ID NO: 1859 - DNA, 201 bp, Homo sapiens
ggcttatccaagtaaataactgtaagctaaaagaatgtccaatgactaggtggcccttagtccaaaaaaaggctgggctccaaatgctccttcttaatttyttccctttattttgaacctgtttttccatagaaataatgtgatacataacatagtgatacacttgtgttaggctactgcaaaattcagcactccagagta

SEQ ID NO: 1860 - DNA, 201 bp, Homo sapiens
agaataaaatatttttagctctcttctcttacactgtgacttttatgggactgagtaaagttggctggtatggggttggggcactaatccaaaggctctgyaggacttcagattgggcaggacacatgctgagcatccctgctccctggaccacctcctggtaaatgacatcattgttatcatcctgattcccctccagct

SEQ ID NO: 1861 - DNA, 201 bp, Homo sapiens
tcactctcctataagctattaagtgattttagacagggccactggagttacatccaggcatattgtaccctatacagctccaggagggtcactcagattayggggcctcttggagtatgtagcatacaacctgcacaaccatacaagttacttgatggtccaccgagaagtaaagcgacaggacccagtaaattgtaaagt

SEQ ID NO: 1862 - DNA, 201 bp, Homo sapiens
aagtgtgatagagcttaaaattcttaattattttactttgaaaatttcatacaaccaaagtcattaaaagacattagagctcttttggtttagagcccaartcttactaatggctgtaaggtagatatctttacttaaacagtgtatatattcctctcttttttcttttttgccttctataccctcatctgtcttgctctt

SEQ ID NO: 1863 - DNA, 201 bp, Homo sapiens
atgggacaaaatccattaggctggatgatttatggcttttcagcatttagcaggagtggctttcaatgtgaaattggttgcgtgcagcaaaccattttagraatttgtctcacgttgcccataagtgattcatgccatgcttcccatgcctctttttgggaaaaggggaaacaatatcaacacaaagcaaattcagtgtcc

SEQ ID NO: 1864 - DNA, 201 bp, Homo sapiens
gagaggcagagcagagaaataaggagaatccagggttgtgaagacacctcacagcccattacccagctgactgtgaagctgccctgcctgtggcctctttwggaaggcgagctggagatccccttactgccaaaccagtctgtttggggttgtttaacagtatactgaggcaggaggacagcttgaggccaggagttcaag

SEQ ID NO: 1865 - DNA, 201 bp, Homo sapiens
agcaggaccacagacataaaccaggattgtcccaagcacaccggaatgcagcgtcatgctaatcttaacggataggcaccatcagcattctccaggtgaawcaccttaaacttgaagaaataaaatcagttattcaaaggaataaaataaccggattcaggcccttctctaattgctcctccacactgcggccagagtgat

SEQ ID NO: 1866 - DNA, 201 bp, Homo sapiens
cccttattttatttactgcctggtgctcactaggtaggaagcatccagaaggaaaccaggttgtaaggaacagtcttgcctctgcagctcctaacaccaasgtcttacgcacaggaagtgctccataaatgttttcttgaaaaagtaggtcacgtgcaaggaactgaggctgagccgggcgtgtttaaggatgggccttca

SEQ ID NO: 1867 - DNA, 201 bp, Homo sapiens
cagtcacactggtgggcagggcttcaacctgtgaattctgggggggacacaattcagtccattccaaaagtccttgcagtttgtgtggatccactcggggrccgctgcctagggcaggccggtgaggcagcctggctatgctcctctcctccccggagtcacactcacctcacaggtccagacacctggtccctgggctta

SEQ ID NO: 1868 - DNA, 201 bp, Homo sapiens
acctgccagagctgctccacctggctgggatctggggcctctcggcgccgtctttccctgggtcagccttttcccacgacggggctgcgcgagtgcatccygagttgcagcagccgtctcctctgcactgctccatcagcgagcttttctgggctcctccaaggagcatgagccctgccttctgggaggccccattctctc

SEQ ID NO: 1869 - DNA, 201 bp, Homo sapiens
cctcttcagcagtgaaacagggactcataaagacagctgtgtgtctggattttgaagtcaccaggcaggacagcgatgtgagaaggcttcactgtctcccragaggtgtgtgtccacagtggtgactgctgtctccatctgccgtgtttctgcggcccctccagacccagcacaggccagggaaggcagaggccctccaca

SEQ ID NO: 1870 - DNA, 201 bp, Homo sapiens
aaggaatactgacacagcttgaggggcaatctagcatttcataagcaatatggttgtgtgtggtcagaatgccaaggagtgattaccaaacagaaaatgargagtttcaggtaagagctgtttctataaagtaacatgtccatcatctgtatcaatgggctggccaatggctgtctcaaagtgaggaagacaagtcagagt

SEQ ID NO: 1871 - DNA, 201 bp, Homo sapiens
actggggtcttaagaatccaaacgcaataggtattggtattggttgttcatactcttcttccaaattatgttaaacatttttagtaactacactttccccygtaaacatcagacttaaatagaccatatgtaaaaacaacctatccttagtaattttactaggcaatctacagcaaaagcttaatatatacacagaaagag

SEQ ID NO: 1872 - DNA, 201 bp, Homo sapiens
tgctgtacggcactgtggtcatgggggtggacgctggagctcctgattagtttgagttcaaatcccagcctcgctggtgggcatgcttagaacagaccctrgcaggcgccaagccccagtaagtggtggagtcattggtaaaggataatgctgaatgcaggacatttatatggatgaaagagtatgggaaagggaatttca

SEQ ID NO: 1873 - DNA, 201 bp, Homo sapiens
agaacagaccctagcaggcgccaagccccagtaagtggtggagtcattggtaaaggataatgctgaatgcaggacatttatatggatgaaagagtatgggraagggaatttcagtgatatgaattccaaagcgtgttagtatattttataagaaacaaaaaggtattcaccagcaccaccaaactccatcatcagtcacag

SEQ ID NO: 1874 - DNA, 201 bp, Homo sapiens
gtacatctgtaggtttgctatataggtaaacacatgtcataggagttcgttgtacagattatttcttcacctgggtactaggcctagtacccaataattaytttttctgatcctttccctcctcccaccctccacccccagaaggttccagtgtttgctgttcccctctttgtgtccatgtgttctcatcatttagctcct

SEQ ID NO: 1875 - DNA, 201 bp, Homo sapiens
ttcttgtgctggttctttctcatctctgcatgtgggtattcttttaactgctgggctgcttctgattgaagtggtcaggcaggagcagggttattgtgctrgagtctgagatcaggcagccctaaccagtgaggataagtgaggaccaggacctgtatggagaacaatccagtcacttttctgtgaggtaggtgttctgta

SEQ ID NO: 1876 - DNA, 201 bp, Homo sapiens
tctttatttacaaatattttcttttttgtacacaaagttcctggctactctaggctggttagtacagggttgatcaccctaaaatatctttgccacaataygaatgatgtgcttttgatggtatgtcccagatacatatttccttttgtggcctgacatatggcattgtctggagaatattcaatatatgcttgaaaagag

SEQ ID NO: 1877 - DNA, 201 bp, Homo sapiens
tatgctatgttctttcccactgcattctagaaacatatttattataataataactagcattaattttgagcatttactaaatgaccttttcatattttgaygctgtcttcatgagaacccaaaaagtgagctctattaccatttctaatttatacacgaggaaactgaggccagattagactgagtaattttcccaggttt

SEQ ID NO: 1878 - DNA, 201 bp, Homo sapiens
tgccccatcttgtaggtaataatttaaaaatgaatattcagtaaagcagacacaaaaaagatgtaaaaataatcaagagatttcagtgttacagaagtcaraagaaaaaaaactgtaagagggaagaaatatatagtaatatacaaaattttaaagaggttaaggacaaaaagtctaagaaaatattactaagtttgatga

SEQ ID NO: 1879 - DNA, 201 bp, Homo sapiens
catacttggcccaataatgttaaatatggaccatctccttcattttcacattagaatctcttgtgtcagagttgtaattagcatttgaacatcagcagaayatagacacagtacttatttgtaaatgcttttctctaaatctttctacaaccaatggctaatgattgaataacacaaatctcccatttttgcaagagcaat

SEQ ID NO: 1880 - DNA, 201 bp, Homo sapiens; identical to SEQ ID NO: 1876

SEQ ID NO: 1881 - DNA, 201 bp, Homo sapiens; identical to SEQ ID NO: 1878

SEQ ID NO: 1882 - DNA, 201 bp, Homo sapiens; identical to SEQ ID NO: 1879

SEQ ID NO: 1883 - DNA, 201 bp, Homo sapiens; identical to SEQ ID NO: 1876

SEQ ID NO: 1884 - DNA, 201 bp, Homo sapiens; identical to SEQ ID NO: 1879

SEQ ID NO: 1885 - DNA, 201 bp, Homo sapiens
gggcccagagtctcgcccggcgcttcctttctcctcccctcctctgagtttaaagaagaccctgaatgtcaggtcccagcagcccctcgctgggtttttcyaacttgtggtaagaactggttttctggggttttttgtttctttttgtttcccccctcttggcatgtaatccccagctaacagattttatcataataattc

SEQ ID NO: 1886 - DNA, 201 bp, Homo sapiens
ccacgtgccccaccgaggagaactggaaaagctgtttcccaggtactgtcggggtgtaggccccccgtgctggccccgcagccatggcgagatcattggcrgcccggccttgtctcactcactctcttgcaggtccgatgtggcctccgtgaactggagtgcaccttcccaggccttcccacgcatcacccagctccttgg

SEQ ID NO: 1887 - DNA, 201 bp, Homo sapiens
tgccatcccaattcaccatcagtgtgcatattaagagtttcagtgttactgaatgccaagaactattatcacaccatctatttcaagtggtgaggtcctcrttgccagctatcatgaagtgatctagtgtctcttttcctggacaacttctgattttaatggttgtttgttcagtacctcggtaatagactctgagatgga

SEQ ID NO: 1888 - DNA, 201 bp, Homo sapiens
catttctttttaattgtctggctcacttctagtccctaactaaatgctcactcaagagttttagcttgaatgtcaaatgtcaaaaaattaattgggtgatytttctccatttctaggataagaagaaagagaagaaatgaagtgaccatccagcctttcccaattagacttcctctccttccacccctcatttcctttttg

SEQ ID NO: 1889 - DNA, 201 bp, Homo sapiens; identical to SEQ ID NO: 1360

SEQ ID NO: 1890 - DNA, 201 bp, Homo sapiens; identical to SEQ ID NO: 1361

SEQ ID NO: 1891 - DNA, 201 bp, Homo sapiens
tagttgcacccatactggcaattatcataggagcttctgttctgagtcttacagacagtgcattaaagctatacattgagatctattgtgcaggacacttygctgattctcaaaaaaagaaaggcacagctcttctagaattgtcataaaggaaacaagactcaagctatgtaataaaaatgtttgcaaaacatttgaatt

SEQ ID NO: 1892 - DNA, 201 bp, Homo sapiens
tccaccttagcctcccaaagtgctgggattataggcttaagccaccatgccgagcctagtagctcaattttaccatgcttgttctccgcttgtcatattcrttgtagacccaggccttcctgttagaatttgaccattattctgactggttcatctaggttactcccagttgacctgttcggactccacatgtgcccgtgc

SEQ ID NO: 1893 - DNA, 201 bp, Homo sapiens
taaatgtagaggtgggcctctgttggcatttgccactgttgagaactatccttatgttcaggcatctcctggcagggattgtgtgaaaaattactttagayactcaaaggatagggctttgatcgcttgagttttaggcaaggttagcccttaaataatttagtaaaatacagtcaatccttgttattcacagactctata

SEQ ID NO: 1894 - DNA, 201 bp, Homo sapiens
atatatcaatgaagacttagaataatgggtagaaaagagatatcagcttattgtccatatcagagcatgtgatgattcttcacagtgtgcaggtaccaccktttcttgttcaggtccaaaaatcatgttcttcatgttctttattgtcaaatatgccattcctggctaatttcatatctcccaccaagagaaaaaggtagt

SEQ ID NO: 1895 - DNA, 201 bp, Homo sapiens
tgggagtggcagggaaagcatcaagcttttgcgcatttacttcatcaaatcctttaccatatcagattatcacttagtggctattaggctgtctcaaaatrtccatggccctgtgggacaagagagatagtataaatgtgctagaagaaaggtatgccatttaaacaaaagtacagacgggccccaatttatgatgattgg

SEQ ID NO: 1896 - DNA, 201 bp, Homo sapiens
taatttatgtgtgctccccatttgggctaaatatggtgttattagggagggattactggtttatactggaagaagattatgtatttaggattttggggccktcttaggattcagtatctgtcaaacgttatagagagggagatgaagtagtgtcaacgtttggtacaaaaaataatttactgaaggcagtaggcatttcat

SEQ ID NO: 1897 - DNA, 201 bp, Homo sapiens
gggttatctcctcagccccatccctgagaaaacactactttttctcctgcctccaggttataagcaaatgttaggaagttcagacgagtgtttgaacccartaaaggtctcttgcaaaataaatttgaaactttcaagtgtttaatgattgattgattctgactctaacaggctggcctgctgtctgccttgggctccctg

SEQ ID NO: 1898 - DNA, 201 bp, Homo sapiens
aattttaccatgcttgttctccgcttgtcatattcattgtagacccaggccttcctgttagaatttgaccattattctgactggttcatctaggttactcscagttgacctgttcggactccacatgtgcccgtgccaactaaggatagccattttccttaagcttgggaaatattccttaagcatcttttctctcttgct

SEQ ID NO: 1899 - DNA, 201 bp, Homo sapiens
tcgaactcctgacctcaagtgatccgcctgcctcagcctcccaaagtgctgggattacaggctaaaactagacttttaaaagagaataatctactgaagayattgtagtaatgagtacaccagtaataacaatgttagtacaccagtaataacaatggttaccatgtattgaactcattctatgtacaaagagctatttta

SEQ ID NO: 1900 - DNA, 201 bp, Homo sapiens
ctggctaatttcatatctcccaccaagagaaaaaggtagtaactcctgttactataattccacaggtctttgcaacctgtttgtagtgaaacaatgtagayatttttgtttctggagttccttaatactcttggttacaacattactcatgatacattattcatgatgtcgtccatgactctctcaaaaattattactgta

SEQ ID NO: 1901 - DNA, 201 bp, Homo sapiens
gagaataatctactgaagatattgtagtaatgagtacaccagtaataacaatgttagtacaccagtaataacaatggttaccatgtattgaactcattctrtgtacaaagagctattttaagaactttatttgtattatctcacctaatctgcaaccttaggaaataaggattgttatgtactagtattttacacatggta

SEQ ID NO: 1902 - DNA, 201 bp, Homo sapiens
ttaacgtatcgtcacttttgttttctgtctctgtttatatactcatacaaatacatgtgcactttttggaatgtgctgaactaattgaaagtaaaaggcartcatgctgtttcaccccctaatatttcagtgtgcttcttctatgaacaaggacatcttcctgtataagcataataccattaacacattcctataccagtg

SEQ ID NO: 1903 - DNA, 201 bp, Homo sapiens
ccttttatttagaaaaaggtctgaatttctaaccttggcctacaagattcttcatgagctgacccctctttcactggcctttctgctgtcacataccactyatgttcttcattcagctgtccttaagccactttggcccctttcttctgtccctgggtcactccaagtgtgttctcgactgagggtttgtgcaccagcttc

SEQ ID NO: 1904 - DNA, 201 bp, Homo sapiens
aatttgttcataataattttccatagatgtttgttaaatactatgctctgggatattttctcatttggatattctccgtacaattttgagccaagatagaraaggaagcgcatggactggtagaaaatatacagttctgggtttcacttatagtatgatattaggaatttcatttaggttttttcatctgtagaatgcaag

SEQ ID NO: 1905 - DNA, 201 bp, Homo sapiens
tttttagtaggaatactaactaggtgatgtgtatttccagttgtatcatattactggtgaagctaggtgatccatggggtgatacctgggcactatgaatmacctgtttccctgcaactttttacccagtggttgtaatatcgatggttgagtctgtcttgcattagttaatacatttgacatggtaaaacagtaaatttt

SEQ ID NO: 1906 - DNA, 201 bp, Homo sapiens; identical to SEQ ID NO: 1521

SEQ ID NO: 1907 - DNA, 201 bp, Homo sapiens
cagcctggccaactctgatgggcaaaggggctgcccagagaatgctgagaggatcaccccaactcagaccaggaccatacctgcctccacacccagaaggrcacagcagggcttttgctttagaatgaagagctaatgaattgcactgacactgacagagcagccttaacctggagtttatcccacaataatcagattcat

SEQ ID NO: 1908 - DNA, 201 bp, Homo sapiens
agtgaatctcatgtgaatattgccctgatacgaacttcaatataggaagctcttaactcttgagtcatttgggacttgggacttctgtgagatgatgtttytgaacactggtgatatacacaaaaatatgtatcgatctagacactgttacatagttggtagatcagggtggtgatctttgagggattcacagcaaagtca

SEQ ID NO: 1909 - DNA, 201 bp, Homo sapiens
atccttcaaatgtcaacagagattattacaggtacatcaaacaaacagaaatgtcatagaaaagtgaaaaaagagaggaacatgtgcagtagcatggtatrattacttaacatcaatctcaaacctgcaggtggtatttatacaaataagctaaagagacataatccaggcccttttagaatttaccagtcaagagggtct

SEQ ID NO: 1910 - DNA, 201 bp, Homo sapiens
agggttctacattttataacagatgaaatattgctattacatagtcagaactctgaggacgggctcaccattggaaaatagaaatggaagggtttccttarttcaagtgaatatgttaaaagatgggaaaaacaggaaagctaaagatctggaaggtcaaagtatcaaaatgtgccaaattcaataacaaaaaggggcttc

SEQ ID NO: 1911 - DNA, 201 bp, Homo sapiens
aagaacaatagttgtcagggactagagaagcggtacagtatgttccctcagcacggatacaagcagggacttcggttactgcactagtggtgctgcacaartattactgctcacttgctacagacaaggccctactctaggaataggacatacagcagatgacagtcaaggacctcaaggggttcatattctagtagaagg

SEQ ID NO: 1912 - DNA, 201 bp, Homo sapiens
ttaacatagattttacaattttcatccattatctcaggctgttttatttcccaaaggtaaggacgagaattagcactccgtgttctattgttttcagtgaygtcctcccagcttttctctaaagctggaaaaacaggggactacaaagcaagagctggcaaatcggtggaaaccaattattcaactcttttcagttagtgg

SEQ ID NO: 1913 - DNA, 201 bp, Homo sapiens
tttataaccttctacttagcattttactatatcattgtggagtgctgacatgtgtaacactatcttacacattaaatgttcaagtatttttttctaccaawtagattataagctccttgtgggcagaaatatgacttggtctaacttcctttattatagaatgtctaatctgcaagaaaccttatctattatttagttcag

SEQ ID NO: 1914 - DNA, 201 bp, Homo sapiens
agcattcaataggctgttgccctactaagatgataactactaatcctttgctagtgaaaacccagactttaaattttttttttgaaagcatttaactattkatgttggttgatgaagtcaactgctcaagtgagactgataccttggaaatgtctagctggtgttaatggttcagtttgggagctcttggttgggaaagca

SEQ ID NO: 1915 - DNA, 201 bp, Homo sapiens
caagtaaaatatttggcaagaaacctgtaaactacataaaagaggcttaaaaatcaaatttggaagttaaagaaaaaaatcacccagataaactataaaaygcaggtaacatagatggatgtgatatatttctggttgtcacaatgaggtcatgaggatattctggcattctcatgaaggctagctcagagcactcccaac

SEQ ID NO: 1916 - DNA, 201 bp, Homo sapiens
tcagatttcttggttctcgggcaccagctatgggtccattgtgagaaatttcctacttttcaactgtgagcgctctcggggccttgcttacatttttcaarttatctgcagggatggaattagtttttatttgttgtgtacaaagtccttgctttcggtggtagaatgaaatacttagagaacagtccatggatctattta

SEQ ID NO: 1917 - DNA, 201 bp, Homo sapiens
atttttatatatgttactttgaattatttatatttgtatgtcttttctttccacttgaactgtagatactcagattgcagcagtgatatgttattatcctygtatatagtctgatgctaaggatggcagcaaattcaaccaccttctcttgcaaacgttattacaactgaaccgggaaaaagactagaattttatccacat

SEQ ID NO: 1918 - DNA, 201 bp, Homo sapiens
tctgcttttttcagaagaacattattttttggtttgattatatagatagtaattttcatttcatatgtagctatgcggtcacagagtccgaggttataaasagaacattaaattcaaagtgtgcatatacaatcattttgagtgatttgaacttacgatgtgagtggatcaacaaacacttaaatacttaacatgtgttca

SEQ ID NO: 1919 - DNA, 201 bp, Homo sapiens
cgggaggcggagcttgcagtgagccgagatcgtgccactgcactccagcctgggcgacagagtgagactccatctcaaaaaaacaaacaaacaaaaaaaamcctaagctttagttataagcactgacttggaaaatcagggacctgcctttaggacaaataaacctagtagctatttagggttctggaacgtgaggtttat

SEQ ID NO: 1920 - DNA, 201 bp, Homo sapiens
ggtgacggagacccctgactctcaaatttaaaaacaaaatgcaggttctaattctataggcttgaggtgaggcttcagacacgtcttaaattttttttctytgagatggtctctttcccaggctgcagtgcaatggcaccatcatagctcacccccaccttgacctgggctaagccatcctcccacctcagcctcccaagt

SEQ ID NO: 1921 - DNA, 201 bp, Homo sapiens
tagaatgacatggtggaaactggagagcctgactcacccatcctccctggggccagtcaccctggccaggagtagccccctccatttacctctgtacaccytacagatgaattattttctacatgtgccaagatgtgaaaaaggttggaaagctttaagcagccacagaggtctggggtgaaagaaggtgagagaaaagtt

SEQ ID NO: 1922 - DNA, 201 bp, Homo sapiens
cctctgctggaaggtggtgtggcagtcctgggtgaggctgaaggaggtcaggggaggcgctgtcagggtgggaggaaaaggtgccttcacagtttccacartaccctgggaggtgatgttattatacccacttccatagctcacagagattgaatatctagcctaaggctacagaatgagtggcagaactgaaattttacc

SEQ ID NO: 1923 - DNA, 201 bp, Homo sapiens
ttcactacagcctcaatctttttgctgtgaaggctaagaggacttgggaaggggaggctggaaaagaaaaatcagctcattgcaaaccattctcaggcagwtccctttaaggaaagggtacatttggtggtttagaacctggaaattgagacttgtaatactatctcattaaaagaaaaactttaggccaggcatggtggc

SEQ ID NO: 1924 - DNA, 201 bp, Homo sapiens
ctagtcatgactttgtctttctggtgaccagaccctatcctgaagctatccagcaagacaccaagagaccctcattagtacaaaagatgctcccatcaccyaggaagttccaaggatttaggagctctgtgtcaggaacttggtgcagaggcaaaacacatatattttttttttattttttaagtagaaacggggtccctc

SEQ ID NO: 1925 - DNA, 201 bp, Homo sapiens; identical to SEQ ID NO: 141

SEQ ID NO: 1926 - DNA, 201 bp, Homo sapiens
ggggctgtgcaagctggtaatggggagccatcctgaatctgcccatgggtggctctaggatgagctcctaaattcgtatgcaaatgtgtgtatgtaagackacacttatttggggagggagtcctgagctttctccggactcccagggattctgtaccccccacagagcgcagcagcgagagcgcggtcggggccgggatc

SEQ ID NO: 1927 - DNA, 201 bp, Homo sapiens
acctctctctcaggtacagcacttacccctgtggcccacctgcctctggtgctatgggctattcctgggaactggaactgatggggatgggtggaagggcrtcttttcttctggtaggggctgatctcttttactctccagtaggggtggagtgagctgtggaaaggcccctcctgcttgtctctagcacccccacctctc

SEQ ID NO: 1928 - DNA, 201 bp, Homo sapiens
accctcctaaaaccccagcccaaaacggccctcagttcccgagaacagacatagaagagacccagccaggacactcttaaaaccccagcccaaaacaaggyagtgactggcctggcacagggggtaagagcaggtttcctaaatcacactttggcaaatcctacgcactcttcaaaatgaacacctcctccaggaaggctt

SEQ ID NO: 1929 - DNA, 201 bp, Homo sapiens
ctagaccacaggagcgagaaaggctggactgcctacagaggatccccaccgagccaggtccaccagccctcagttcccgagaacagacacagcagagaccrggaccctcctaaaaccccagcccaaaacggccctcagttcccgagaacagacatagaagagacccagccaggacactcttaaaaccccagcccaaaacaa

SEQ ID NO: 1930 - DNA, 201 bp, Homo sapiens
gccctcctggcttgtcagggtctgcccccagaggctgctgcctggacagcacatgtgggaggtagaggaacctcgagtgagaagtgcaggggcccacaacrgggtcccaggtcccaggtctgtggggcagggagggctcctttagccacccctggggttagggaggggtggtctgacaatgacccttggagagacagagct

SEQ ID NO: 1931 - DNA, 201 bp, Homo sapiens
tctgaccaggtgccttcctctctcagagccccgtctccttcctgtccagcgagagggctcagggcccggcctgcagcgctcagggagatgcaactggaagygtcttgacagagggaccctccggggacgctggcttcattcactccattctgccagtccccacagaggcctggcctcacagagtcacaccgaggagcaaga

SEQ ID NO: 1932 - DNA, 201 bp, Homo sapiens
aaggccccagggcaggatccaatgggagaagcacggcctctcccctcccaggtcgccgccagcaggcagctcccactcactccccatgtagaaagaagacrtccaaacctcctcgacaccagaaactccttctacattttatgcaccctaaaaaattatcccaatgatgctaacatgacacatttaaagctgcacagtcat

SEQ ID NO: 1933 - DNA, 201 bp, Homo sapiens
tagcatctgtgtcacataattcatctctggcagtccacttcttttaaatcctaatagtaggcctcctaaataggattgctagcatttggcatctcatttgmctctatgacaacaaaactctagaagacgtagtttataatacattatggtttcagctgaatgacatttggttctaaggtctttgaaagtacaagtttgaaa

SEQ ID NO: 1934 - DNA, 201 bp, Homo sapiens
acaataaaatacaaagtgatataactgccaaatgtatattacagactataaactcaacagaaattcaaaagaggatgatataaacatatcacacattgaargaggacaaagcatcttgctaggcactgacattttaaaaggttaaagtacaaaagttactttagataggaggaataaattctgctgctctagtgcatagga

SEQ ID NO: 1935 - DNA, 201 bp, Homo sapiens
caaaagttactttagataggaggaataaattctgctgctctagtgcataggaggattactatggttaacagtaaaagattgcatattctaaaatagctacmtgagaggcttctgaaggccctcacaacaaataaatgataaggtaatgaatacaagaactacactgactggatcattatacaacataaatatgtattaaaa

SEQ ID NO: 1936 - DNA, 201 bp, Homo sapiens
agtacatccacacattttacatttcatgccagggttcgtgctgtttcaaactcaataccaaccaggctgaaatcatcctccttactctgggcttctgctcrtcctctaacacagcaaaggctgcatccctagactgtgattcatatttaaatgtctttttctcctctgctgggcagtgtgagcctcaggggcagaaccata

SEQ ID NO: 1937 - DNA, 201 bp, Homo sapiens
ctatctgcggcgcctgctctcaggttccccctctccagcctccttcctgactccgcttcctcattccacacaccttgatgcagatcttctccaaagatctmgcctcatttgccctttcttctatctctacagtctttcactcagcaatctcaatcacttccagcaaccatctcttcaaagaaaaagaccccataaatttct

SEQ ID NO: 1938 - DNA, 201 bp, Homo sapiens
acgtttggagaagatagcagtgaacttggctgacagccctgctctcatggaacttaccttctcagagggaaactgacctcagaactcatctcccaactaascatcccattacctgtgttctactcacactgctgtcttcacccttctccaagtacatccacacattttacatttcatgccagggttcgtgctgtttcaaac

SEQ ID NO: 1939 - DNA, 201 bp, Homo sapiens
attgcatattctaaaatagctacatgagaggcttctgaaggccctcacaacaaataaatgataaggtaatgaatacaagaactacactgactggatcattrtacaacataaatatgtattaaaacatcaaattggcccagcatggtggctcatgcctataatcccagcactttgggaggccaaggtgggcagatcacctga

SEQ ID NO: 1940 - DNA, 201 bp, Homo sapiens
gccatacatttgagatcagtctcactaaggatcatattttcctaaagaaataagcaacatccctcctcagcctaatctttatgtgtgatattttggcccaygtatggtttattcctttgttttattacccaattggatcagaacatgtaagagaaagattggcattatttggccctcatagatctcagcaatgacaatgat

SEQ ID NO: 1941 - DNA, 201 bp, Homo sapiens
tcatgatttgagttctgaatcaccttttgtagttttaatcaaattaatttcattttgttactagaacattaggcacttggttgtctccaagccttttaacwttctactttatctgccttgacacctcttctcttccccaccacactcactagatttttatcctttgggtactagcttgaaagtcactttctctgggaggcc

SEQ ID NO: 1942 - DNA, 201 bp, Homo sapiens
cagtccgacctctaggccaagaaccttggctgttaactcctttaacccatggggccagggataaattggagggtaagctgttcatgtctctgagtaaaagytatttcccagaactccagaaaacgccctgtgtttagaaccctctttgagtgtcaccttgcgtgacatgaaatatttttcaaaacatgtaatcctttaatc

SEQ ID NO: 1943 - DNA, 201 bp, Homo sapiens
tcaagaaaaaaaaagtaagcccttttctctttgaagtcacttcagatttaataccttagcatagtagttaagagaatggactctggagtcagccagtttgrctccccatttcctggctttttgacatgcttagtaatttaacttctggaagcctttgttctctcatctgtataatataatagtaatagaacttacatttta

SEQ ID NO: 1944 - DNA, 201 bp, Homo sapiens
cctccataaatcgagttttattggaacacagccatgcctatttgttgacgtgttgcctatgcctgtttttgtggtatgatggccaagtcggtttgttttascagagactacatgtagcctgaaaaggaaaaatctagttagttacttacttgaccctttatagaaaaagtttgtcaaccaactcattctaaatactttcag

SEQ ID NO: 1945 - DNA, 201 bp, Homo sapiens
tccagcctgggcaacagagcgagactttgtctcaaaaaaaaaaaaagagaaggttcctccaagtcttttcttggcttgataactcatttcttcttagtacygaatatgtcatgatgtgatgtaccacggtttatttatccattcacatattgaaggaacagataaacttagtggcttctaagttttggcaattataaataa

SEQ ID NO: 1946 - DNA, 201 bp, Homo sapiens
cagcctcccaaaatgctaggattacaggtgagagccactgcacctggccttcattctgttctggtatttgattgatagctaggtatgaatgtggatttgtscattcctcagtttagttctgtcaggcttgatataatttgaagctgtgttagtcattgcatatatggttatggatgtgtgcacacatatgattctgtcttc

SEQ ID NO: 1947 - DNA, 201 bp, Homo sapiens
attgtgtgacacatgtacagaatagtgtattaagacataacactctttaaatgtgttataacaacatatataacaaatatatatgcattaaagaataatartaaaatgggtgcccatgtaggcacccaagttaagaaatagaacattatctgttctttatgacaaattttctgattgaatccacctagtagatagccacta

SEQ ID NO: 1948 - DNA, 201 bp, Homo sapiens
ttgagacagtctcactctgtctcccaggctggggtgcagtggtgtgatcttggctcactgcaatctctaccacagggttcaagcaattctcccgcctcagsctcctaagtagctgtgattacaggtgtgtgccactacacacggtgaatttttgtatttttagtagagacgggatttcaccctgttggccaggctggtctt

SEQ ID NO: 1949 - DNA, 201 bp, Homo sapiens
tttgggggcatgttttcaactcatttggataaataccaaggcccctggatcatacactaagaatataattaattttgtaagaaactgccaaactcccttcmatgtggctgtaccattttacattcccacattctcaccagcaatgaatgagagtttttttttttttttttttttggttttaaggagcggaaagtttaatag

SEQ ID NO: 1950 - DNA, 201 bp, Homo sapiens
tgaccctctttttccattcttttatcttttttttttttaatttcctgactcctacaactgatcatccttttactttgaatgtagctatgtttttatatttwaaacaaactgcttatagacagcacatggtttggtcttactttttttatataatttgacctctgttatttaattggtgtgtttatgccaattattgatata

SEQ ID NO: 1951 - DNA, 201 bp, Homo sapiens
tttaaggcttctgaagtccaggcaattaggagctatgtcccattagtaaatggctgtcaagccatatgcaattttcaagttggagcaaccagaagagtttygggtagcatagagttgtcaattcagaacattctaagggagataggacgggagagagggagaagcagaagccagtggaattagtatccagacgattatgag

SEQ ID NO: 1952 - DNA, 201 bp, Homo sapiens
ggtggctatgattcattatcttgatttttctacatataatatgtcttttttcctctggctactttgaagattttaactttggttttcatttgtttggataygatgtgtccatgtgtgtttttgtttgagtttagtttttggtattttccctgtttggataaattgagtttcttggacctgtggtttcatattattattttt

SEQ ID NO: 1953 - DNA, 201 bp, Homo sapiens
aggtcattttgtgatctggcaatgctacttgtattgattttggttttgttttgtttttttaaccacaagctattacctttctctttcaaagtttgaaaggmaacatttgcactgggaattttttaatattgggagactgggtcccaaactaaagagtcagccctgtgatagaacacgtgtgaagacttcccattcggtaac

SEQ ID NO: 1954 - DNA, 201 bp, Homo sapiens
atatttgcatacttttaatatgttttgctggtttgctgttgctttttttgcacatccaactgattcttgctgggcttaattttggttttggtacatctttkaatagtggtaataatgcctgatacttgacatctattatgtactagtcatcattctagatcgggggtgtcaaactctggctcgttgtccagatgggctgct

SEQ ID NO: 1955 - DNA, 201 bp, Homo sapiens
cttgtccattatgtcttcaaatacttcttttctccttttggaatttcagttacatgtttattagaccatttgatattgtctcacagcccttggatgctctrtccttttatgtttttcttccatttctctttgagtttcagtttgacctatcttcaagtttactgaaacttttcttagctcctttgtctactaatgaacctg

SEQ ID NO: 1956 - DNA, 201 bp, Homo sapiens
ttttattgtgttttcattaccattcaattcaaatttttttaacttcccttgtgacttcattttttacccttatttatttagattgtattgcataatttccwagtttttggagattttccagatctttttttttttttttttgagacagagtctcgctctgttgcccagtctggagtgcagtagcgagatctcggctcactg

SEQ ID NO: 1957 - DNA, 201 bp, Homo sapiens
ggaggctgaggcaagagacctgcttgagcacaggtgttggaaactagcctaggcaacataggctagtctctaataaataaactgtctctaataaataaaakaaaataaaattaaattaaaacacattcttcaacatattcctgctcgagggtcaaaaattttaattttgttaagatgccaatacaacctacagaggtgaac

SEQ ID NO: 1958 - DNA, 201 bp, Homo sapiens
cttcaggagagcacaatttaaggggaaatggcaaaaaaaaaaaaaaaaaaagaaagaaaaagaaaaatgaaaatttgattcggtcagatccgcaagttctyctccatactttttgtttttttagaaaataattctttcctctgctggtgcagagtgaggctagctgggggagcctgggccccactgtcctcccggaggtgg

SEQ ID NO: 1959 - DNA, 201 bp, Homo sapiens
ttaatccattatgttaccaaatagtatactgttaccatgttttacgtacacccttgagtaaggtggaataggttaatgtctgtggcataataacacttcaytgaatgcacaatagtatttaacatgttaaaaaggttgaatatattaacatcacatataatctgaaatttaaaaaatatactgcattttatataaaagtat

SEQ ID NO: 1960 - DNA, 201 bp, Homo sapiens
ctcgtttacacttacagattctgtcatcaaattctatttatacctggagtctctcacataactgtagcaggtcactcactaaacaagatctgaaaagcttsaagagccacactctcaaatgggggcttcaagatttctacactgacatctcacaatacagaaaatgccttctgttggttttcagtacattctcaatccaaa

SEQ ID NO: 1961 - DNA, 201 bp, Homo sapiens
caggctaggcccctaggagcagaagacacagagaagtgagagcaaaacctggagctccggctacagcgagagacaaagaccccgccaaacccggaagccgyccagtccgctccagctgcatgcctgattggacggtttccagcccagcgtccctggttggataatgcttaaatccccgccctgtcaggctttgagtgacag

SEQ ID NO: 1962 - DNA, 201 bp, Homo sapiens
cgaactcctgagctcaagtgatcctcccgccttgccctcccaaagtgctaggattacaggcgtgaaacactatgcccaactgtcaattttcttaccattcraagtatgagcttgcagtttcatgactttagtgcttctctcttctgttttctaatcttaattttttctttctgctacctttctatttagtttggttttttt

SEQ ID NO: 1963 - DNA, 201 bp, Homo sapiens
ttcctaattatgaaggaaaagccttcattatttcaacactgagtatgatgttaccttttggctttttatataaggcttctgtatgtaaagtagattcctcrtattcctaatgtgtagagtgtttctatcatcagtagttgttgatgtttttcaaatgttttttctgcatctgatgagcctatcaagtgggtttttgttttt

SEQ ID NO: 1964 - DNA, 201 bp, Homo sapiens
cagtagttgttgatgtttttcaaatgttttttctgcatctgatgagcctatcaagtgggtttttgtttttattctgtttttgtggagtattgcagggatcratgttcctaagttgcaacatcgttgcattccaggagtgactttcacatgatcatagtgtgtggtccattttaatatactgctgaacttgcttgctagcat

SEQ ID NO: 1965 - DNA, 201 bp, Homo sapiens
ggcaaagtggtgataaatagaagtagtcagtggaattcttctagtgtggcctctctttgcaaccttggacccattttgtttgcctgtcacccatcccttcyaccactatgacatgaaactaataagctgaccttgtctgggagagcaggtatatcttccttagggactttcagacaaccctccactgacactgccagctca

SEQ ID NO: 1966 - DNA, 201 bp, Homo sapiens
tgggaacttatcactcattgttgatggcatttttcttctgtatagcagtctttgcttttcttcctatcatcaaacagattaagaatggacactctcctcayctgtcttacaattctttatttagagactaataaagcgtttcattccttgtttcatataaagtctttgtgttaaaactcttttatttatctctgtctttca

SEQ ID NO: 1967 - DNA, 201 bp, Homo sapiens
ctgctaggcagataaacatataaactcacattaaaggcctatttacttcagttcctattattcaataaatcatgtccagttttcaacaaaaaattacaacrcatgtcaaaaggcaagaaaaaaacaaggtaagcaccaaaaccagactcagatatagcagacattatggaattactgagtatagtcccaggataagcagta

SEQ ID NO: 1968 - DNA, 201 bp, Homo sapiens
tgatatatctataaaaattattacagagtttagtggggccagattatgtatttaaaattgaatacataaatcctggatctatatcaaatgttggcatcatrtcactatagtcgattaggtgaaattggttttcagaaatatatacatggggtagggtgtgggttatctcttcatgtattagatttatgatgttgtatagtt

SEQ ID NO: 1969 - DNA, 201 bp, Homo sapiens
tttttagaagccacacaattcaaaaactagataacagcaaatcaatttttctaatttataattcagcaagataattttttgaattttaattttattttccrgattaagtgttgttatagcaaagctaaaaaaaaaacacactgaagtctaatgttaggtttattcttgaatcataaatagatttttctatattgaataaat

SEQ ID NO: 1970 - DNA, 201 bp, Homo sapiens
acttcacaaccttccctccctcccctactcatcaacctgggtgccaattgattccaagtcctctgaagaattctgtcgtctttctttgccttcttttagawttttttccttaccctctctctaatgtttgtgtttactttttgaacttttaatcaatatcaaataaaaacaaatctagacttaagtaaggagatactttat

SEQ ID NO: 1971 - DNA, 201 bp, Homo sapiens
ggagttcaagaaggtttttgttctatttggacacttgcttttttctgacatcagctgaaatctcaatgacttcacaaccttccctccctcccctactcatyaacctgggtgccaattgattccaagtcctctgaagaattctgtcgtctttctttgccttcttttagatttttttccttaccctctctctaatgtttgtgt

SEQ ID NO: 1972 - DNA, 201 bp, Homo sapiens
agtgtctctaaacagttgagtcagttctatctctccatctacactgactcacatctcagtccccatgcctcttcctggcccagctcctccatagatgaacytgtggatctcaccacttacaggatcttgccatttcagagtgattatttacttcagtgcatctcagactgctcagtcccttgatatcatgccttatttccc

SEQ ID NO: 1973 - DNA, 201 bp, Homo sapiens
ggcactgtctaacattccctggggaatgatactttcagcatcgttttcaaatagtattcaagagagagaaaactccaaggcagcagatccagcattttcarattttaaggctcaactgagaagaaaagagttcatccagaaaagggtataaattccacttgacttacatcgtagcactttccacacacctccattatggaa

SEQ ID NO: 1974 - DNA, 201 bp, Homo sapiens
tcacaaattgtttcctaaaagcacttttgcagtttatttttattttggtgattgcatttttatgtggagtgtggctggtgctaggatggtgctgttgtcakccatgtagaggctcatggaagaaatgtacagggaatcaatagatttaagaataaagatggcagagcagaactgggaggatgagcagagctgagaggagtc

SEQ ID NO: 1975 - DNA, 201 bp, Homo sapiens
caatatagcatattccccactgaatctgcatacagtgtctctaaacagttgagtcagttctatctctccatctacactgactcacatctcagtccccatgyctcttcctggcccagctcctccatagatgaacttgtggatctcaccacttacaggatcttgccatttcagagtgattatttacttcagtgcatctcagac

SEQ ID NO: 1976 - DNA, 201 bp, Homo sapiens
acagtttgatatatatttttaaaagtatgtacatgcgtggaaaaattctagaagtgtacgaaaaggtgagtaagagcatcttaaaaacaattgcttcatgyttttcattcagtggttctcaaactttattgtgcatcagaagtctgttaagatactgcatgctcagtgtcagccccacagattctgattcaataggtctgg

SEQ ID NO: 1977 - DNA, 201 bp, Homo sapiens
tccaccttcctctaaaaagcagttataaatccacaatccactaatgtacatgtatatacattatagattaggttaacatacacaaaatgacttgcttcacyaactaggagtagcaatatatcatatctcttttattttgccaattaatcattcaaacaacagtagtttcctattagcaggaagtctaacatttcctgatgg

SEQ ID NO: 1978 - DNA, 201 bp, Homo sapiens
tgctgcaaaacagaatatactagctctgttactgattaactctttgcatttctcatttcaatgcaaactgaaatcgtagtaaatgttgagcaagatagatrgctaaataattttaaaaatctgtctacaaagagtcagcttgcgcctgaggttagaggtgtgaggtagagtgctctatatttgcactgcaggtcgctgata

SEQ ID NO: 1979 - DNA, 201 bp, Homo sapiens
tttcagtagctcagggatctccactagagaaactgaaggcatctgctttcaatactcatgtctgtaaaaccatcacagagagggaaatgtgtgaaccttcrgactccagacactgctgcatttaaaaagaattgttgctatgaatattggaatattttccttctggtcactgcttatgacttatatgtacggcagaagatt

SEQ ID NO: 1980 - DNA, 201 bp, Homo sapiens
ttttcaacgtgtaattggtttatctggatatagcatcatcataagttcaggagcatctgtatcggtttagaggtaagcatatgacctaagttgtcccaaamagtataaaagaaagagcatttatttgagtgctggagaaaactagttttttctctcccagtggacatgaagaggaaaacatttagccttttttgtcactga

SEQ ID NO: 1981 - DNA, 201 bp, Homo sapiens
gctggagaaaactagttttttctctcccagtggacatgaagaggaaaacatttagccttttttgtcactgagaacctactggaaacataaggggagccaastttagaataaaatagagtgtggatagcaggatgaaagtagaaagaacctgtggctttgacgacatagttgagcctttaggtcccctgccctgcagtccat

SEQ ID NO: 1982 - DNA, 201 bp, Homo sapiens
acagaaacatgattagaataaaggaattgttaattcctatgccagtactgcttttataagtgtatttgaataaaaacaaaatgaaagaaactaaatcagtraaagtaatacaataaaaataaatagggaacaaaaaaagaaaaataaagagaaaaggccacttgggagctaagtgccttcttgattactaagcacatacgt

SEQ ID NO: 1983 - DNA, 201 bp, Homo sapiens
aagggtgttgggtcttctcccttttctgagacacatattatttttgacatgaaggacattggctggaagaaaataatgctacaaatgattattaaattaakgtgggtattggaggctatgcagtggagcctaaggcttttatgtattctgagattgactgaaggtggctattttctcgctaaaccagtggttcttaaagtg

SEQ ID NO: 1984 - DNA, 201 bp, Homo sapiens
attggaggctatgcagtggagcctaaggcttttatgtattctgagattgactgaaggtggctattttctcgctaaaccagtggttcttaaagtggtccccmaacagtccagacttctggtttcttcttacacatgtaaataacttagaaatgtctcacctgtcctcaccacaagaaacaatgtagttcaacaactcttctt

SEQ ID NO: 1985 - DNA, 201 bp, Homo sapiens
tatgcagtggagcctaaggcttttatgtattctgagattgactgaaggtggctattttctcgctaaaccagtggttcttaaagtggtccccaaacagtccwgacttctggtttcttcttacacatgtaaataacttagaaatgtctcacctgtcctcaccacaagaaacaatgtagttcaacaactcttcttagtctatca

SEQ ID NO: 1986 - DNA, 201 bp, Homo sapiens
ttttttgttggaatttcttttcctcttttaaaatgagcataatgtcaagctttgttagtagattagactggagggacattagtagggtaagggatgttctrctgggtctggtgctatgttttgtttatgctgctgaagttgcatcatgagccagttgtgcaggaatgtcagtacatacagtgtgctatgcctcagctatat

SEQ ID NO: 1987 - DNA, 201 bp, Homo sapiens
ctaacaccttttcagttggtagttgatgcttttttctattctgacaccaacttattgggtacctttggataagttaaattttctaattttcttcagttgcytaatgaagggttagagtaactgacattcttgtggcacagaaaaacagtgcttatatttcgccttaacaaaacagagttctaattttgttctgatactaat

SEQ ID NO: 1988 - DNA, 201 bp, Homo sapiens
tgacacattgattagagaaaaaaatgacaaaacagtacagtttgatatatatttttaaaagtatgtacatgcgtggaaaaattctagaagtgtacgaaaakgtgagtaagagcatcttaaaaacaattgcttcatgtttttcattcagtggttctcaaactttattgtgcatcagaagtctgttaagatactgcatgctca

SEQ ID NO: 1989 - DNA, 201 bp, Homo sapiens
gcgtggaaaaattctagaagtgtacgaaaaggtgagtaagagcatcttaaaaacaattgcttcatgtttttcattcagtggttctcaaactttattgtgcmtcagaagtctgttaagatactgcatgctcagtgtcagccccacagattctgattcaataggtctgggtggtgcccaatgacttgtatttctaacaaatta

SEQ ID NO: 1990 - DNA, 201 bp, Homo sapiens
ttaaactgcagtttttatcattgccattatctcatggccaatccactcatctgaattttctaacaaatgcattgggttgaatggagcaaaacaaactttaytggcaacactttgaaactcacttttagaagctttggtcacatctaattccaaatccatcattatagtttgcggactcaattgaattttttttctgcattt

SEQ ID NO: 1991 - DNA, 201 bp, Homo sapiens
aatccactcatctgaattttctaacaaatgcattgggttgaatggagcaaaacaaactttactggcaacactttgaaactcacttttagaagctttggtcwcatctaattccaaatccatcattatagtttgcggactcaattgaattttttttctgcatttagacaataacgtggtaataagtcaatcaaacatgatgca

SEQ ID NO: 1992 - DNA, 201 bp, Homo sapiens
tgcattgggttgaatggagcaaaacaaactttactggcaacactttgaaactcacttttagaagctttggtcacatctaattccaaatccatcattatagkttgcggactcaattgaattttttttctgcatttagacaataacgtggtaataagtcaatcaaacatgatgcaactattttgtgattgtgattctggggga

SEQ ID NO: 1993 - DNA, 201 bp, Homo sapiens
taacgtggtaataagtcaatcaaacatgatgcaactattttgtgattgtgattctgggggattttagacattaggaagtttagacagtaggaatttggacrttaggcatttttgatcttctgtaatttcagcatttggcattatggtgttcaggattgtaccgttcagaaaatgatccaaatccctgttttatgggctagt

SEQ ID NO: 1994 - DNA, 201 bp, Homo sapiens
catttttgatcttctgtaatttcagcatttggcattatggtgttcaggattgtaccgttcagaaaatgatccaaatccctgttttatgggctagtttgcamattctagaatttaatatagatgacatcatatagtatgcactcttttttgtctagcatcttcaactcaatgtatttattttgacattcattcatgttttta

SEQ ID NO: 1995 - DNA, 201 bp, Homo sapiens
aggtaggtcaggggcattgtaagtgcctctcaagaagatacaaactactccacaaaaaataaagacacctttgaaatctaagatatccagtctgtcaaatragaactttctgacccttctttcctttgccttctcctgttccaacattaaccagaccagattcagtacaatgagtgaggaaattgaaatcgaggagcaagg

SEQ ID NO: 1996 - DNA, 201 bp, Homo sapiens
attctagaacaggtagaattaatttgcagtgatagtagatcagtggttgcctggggacagggatttgacttagcaagggttggtagtaaatgttttggaaygatggaaatgttctagatcttttttttgtgctagtaatcatctaagtgtccacatttgtaaaaattatcagtatacttaaaattggtgaattttattata

SEQ ID NO: 1997 - DNA, 201 bp, Homo sapiens
aacagccagaaaaaataagaaaatggcagaagtatgtacttacttataattaataatactgaatgtaaatgaactaaactctccaatcaaaagacacagaktagctgcatggataaaaaacaagacccaatgatctgttgcctataagaaacacacttcgcctgtaaaggcacccatagactaaaaataaagggatggaaa

SEQ ID NO: 1998 - DNA, 201 bp, Homo sapiens
cctcagtgtgaaagaaaagtatgttaatgagcaattagaaatcatctaaaggtgcaaaactcattggtaatagtaagtacacagaaaagcacagaatattrtagtaatctcattgtgatgtgtcaattattcatttctttagtggaaagattaaatgatgaaataaccaaaaataacaatgaagacaacttttacatacat

SEQ ID NO: 1999 - DNA, 201 bp, Homo sapiens
gtctatcagggaattgaggtgacagggtaaattgctatttgggaagctgaagagacaggcaaatagaatcacagcttgccagaaacacaaacactggagcyagtaatgggtaggagcatttgagtgtttcttaaaggtaaccgaaaaattgctgaagctgagtgtggacaagcttgagagttaaaaactcttggaacccag

SEQ ID NO: 2000 - DNA, 201 bp, Homo sapiens
gtttagtactgtcagtggggaattgaaatctcccactattattgtgtggttatcttactctctttgtaggtctcaaagaacttgttttatgaatctgagtsctcagttttgggtacataaatatttagaatagttgagtcttctcattgaattgaaccctttgccattacgtaatgcccttctttgtctgttttttaaaat

SEQ ID NO: 2001 - DNA, 201 bp, Homo sapiens
tgcttaacagtcctgcctcaggatccctgtggattctttgagtatccttttaaagactctactatctgttctatgagaggaacagatgcatctttctatayagtgcagtcagcaaagttcaggagaggggaggccagatgctattcatatttctttcagagtgtagcgtatatcagtggtacttaaaacccgtcttctcaa

SEQ ID NO: 2002 - DNA, 201 bp, Homo sapiens
accttcctgggacttgacgggaggggaagacaatgcaaatatgcagatgattctatttcttgctgttctgtgagtgataaaatcttttttctcctacttayagtcttgtgtcttctgtcaccatccatgaatcagtaacaggttaactttttggcttacaagtagggtaaaaatctcagactcttcatggttcttgacaca

SEQ ID NO: 2003 - DNA, 201 bp, Homo sapiens
gaaatacagccttgaattactgatgctacccctccccattccctggatgcagacatgtggcatgaagagacaatctgtgtgcttcgggaaagaagagcacrtagactgtggaactttgcattggaactcagtgatgccctcttatagtgggaagcaatacaggacagaactcagtcagcacctacagatggagaatttaga

SEQ ID NO: 2004 - DNA, 201 bp, Homo sapiens
tcttttctttgtggtgagaatattcaaaatctatacttttagcaattttgaaatatacagtacattattaaaactacagtcaccatgctgtgcaatacttyaccagagtttatttctcccaattgaaatgctgtggtctttgactactgtctcttctttccctgctctcccctaatcccagtctttgggattccagtctct

SEQ ID NO: 2005 - DNA, 201 bp, Homo sapiens
taacaagcactccaggtgactgtgtttgaagatcactatattaagcagatgtaaaatttgtaatttcttccttttccttacttagatttcttagaaatagyatggtaacaaggtgattcaaaatgtaaaagactcactgaaaacattgttgtgattttgacttttagttttgctaagcaatatcattgctaatgaagagtt

SEQ ID NO: 2006 - DNA, 201 bp, Homo sapiens
atgtttattttcttattattgcaatttgtgtctttcaaggaattggtctgtttcatctagcttatcaaatctgtgggcaaagacagttgttcataacattmttttcttaatccatttaatgtccatgagatctacagtctctctttcatttctgatatcagtaatttgtgttttctctctattattcttagttagcttagc

SEQ ID NO: 2007 - DNA, 201 bp, Homo sapiens
tgaaaatacagtaaaaagagacaaaactggaaagaataaaaaagaagaatacatcctgcctatgagagctagaaaatagtctcaaaaaggaaaatctaagygttactggcctaaaagaagaagcagggagagcgatttgggtagaaagtttattcaaagtaataataatagagaacattccaaacctagagaaagatatta

SEQ ID NO: 2008 - DNA, 201 bp, Homo sapiens
agaataaaaaagaagaatacatcctgcctatgagagctagaaaatagtctcaaaaaggaaaatctaagcgttactggcctaaaagaagaagcagggagagmgatttgggtagaaagtttattcaaagtaataataatagagaacattccaaacctagagaaagatattaatatccaagtacaagaacattatagaccacca

SEQ ID NO: 2009 - DNA, 201 bp, Homo sapiens
tatcgacatgaaataaactgcacatatttaacatgttaaatttgatgttatgacatatatgtatacacattaaattatcacagtcggtataatgaacattkcagcacaccctgaagtttctttttgcccttttgtaattctcccctccaacttctctgactctccttctctcccctgccgtccctctggcacgtctaatag

SEQ ID NO: 2010 - DNA, 201 bp, Homo sapiens
tccagccaagtattgagacagccgtgtgcagcaactgagaaggaaaggtgaggacagtcaaaaaagttaaaagatttaaggcaaatatatctatacctatwtttagcaggaaggaaggtggtgcatgcacataagcatgctttttctgattctaggtaggggtttcagagttttacaagcagtgggaagagcccttgctaa

SEQ ID NO: 2011 - DNA, 201 bp, Homo sapiens
tctcattcaaagtagttacaaataaaatgcaatatcaaagaaatgaaagatctctacaataaaagtataaaacattgatgcaagaaattggagaacacccmaaaattggaaagatatttcaagttcatggattggaagaatcaatattattatagtatccgttctacccaaagccatcttgaaattcaatgcaatccctat

SEQ ID NO: 2012 - DNA, 201 bp, Homo sapiens
taataatagagaacattccaaacctagagaaagatattaatatccaagtacaagaacattatagaccaccaagcagatttaacccgaagaaaattacctcraggtgtttaataatcaaactcccaaagtccaggataaagaaagaatcctaaaagcagcatgagaaaaggaaccaatcacatgcaatggagctccaataca

SEQ ID NO: 2013 - DNA, 201 bp, Homo sapiens
aacatacactgaggaaagaacagtctcttcaataagcagtgatgggaaaactggatatccatatgcagaagaataaaactagactttgatcacttgccatmtgcaaaaataaaatcaaaatggattaaaaacttaaatataagacatccaactatgaaactactaaaattcactggagaaactctccaggacattggactg

SEQ ID NO: 2014 - DNA, 201 bp, Homo sapiens
aaaagtaaaaaaaaaagaaaagggagatttcatagaaattaaaataaacatatacttattgaaacaaatataacagagcaattgatgtggaatgtaaagtwcttaatttccaaaagtgtttttcatctagatggacaagacttgtcacgttggagctaatttttgttcagaaaaaggccacttgaatgggtacattaaccc

SEQ ID NO: 2015 - DNA, 201 bp, Homo sapiens
catgtactcatacacagaccacaaatttggtggaaataatactggtgatcaaatagcaacaccattgcataagtgccttcttatcctaccatgcacataaytgttttaaagccagtcagtaacttcactggcttcttcaggcaaatgtggttttaattaattaaaatctcttgggaggtcatcagctagaaggaatgtcaa

SEQ ID NO: 2016 - DNA, 201 bp, Homo sapiens
tgcattgactcaggcctagtgggtgagtattgaaatgtctcccttttacaggggaatagtgagtaacagggaggtgaagtaacatgcctagggtcactagytggtggatgctggaatttgggttcaaatataggcaattgggtagaaagcccacaattgtgtcaactattttctcctgatgtataagactatttaaaattt

SEQ ID NO: 2017 - DNA, 201 bp, Homo sapiens
ccattgatcttgtgtgaaggctaaaatttatcaatatttccattatagcactacctcatattataaagatttcttttatgaactgtagtcttcaggaagtwtatggttcattctgaaggaggatgagaagaccatttagaaactgttagaattatgggcatgaagactaaacaatagtgtagtttagtggaacgtcacaaa

SEQ ID NO: 2018 - DNA, 201 bp, Homo sapiens
gaaagcctgtagcatggctcctgaatgtgttcctatccttgtggagaccccttccacaatgtaccaggtttgatatgggtgactgataacatatgacagargtgagggtaagtcatttccaagattaaggtataataaaaaataatggtctctgcattatggtctttcctgtctaaagtcttgtgtagtttaagaatacga

SEQ ID NO: 2019 - DNA, 201 bp, Homo sapiens
atcagcttagagaaaaaaaaaaagaagaagccgcctgcaaacagaattgctgaaatacaaaaggaaaataatgctctacaactttctaaaggagtccaagrcaaagggaatgctaaagtttattttgtttctcctgttaaatagttgtgaagccaattggagatttttgaggaaaggagaagggatttcacatcttgtgag

SEQ ID NO: 2020 - DNA, 201 bp, Homo sapiens
atcaattcttatttctgggagtctgaaaggggattatggaaagccactaagatgataagtttcatgttactccttttttggttccagaccagtgattctcraatttggcatgcattgaatcatatggcaacctgtgaaaacatagattgctggtgcctatacctagaggtttgtgtatagtaattgcaagatgtggcccag

SEQ ID NO: 2021 - DNA, 201 bp, Homo sapiens
aaagctttatgttaaacatttggttagtttagtatcttggtatttttttttcaaagaactgttaaaaagtttcttaaaatctttttacagcatgtttaagyctcttgtaaataagggtagtgggtaaaaaatattaattaaaatatccaccagtattcttttcaattatttggtaatcaaaaattctgataatatttcaga

SEQ ID NO: 2022 - DNA, 201 bp, Homo sapiens
aaatccctgctaatttctaacctttactcttctgtgtacctgcagctactcagtgtttcatttttgatggtagcttctttggacaattgctatttgtgcartgcactttattttgtgttcctcattgactgcttattattcaatgattttttaaggatcaagttatcttaataattattaaaagtagatttagagaggcaa

SEQ ID NO: 2023 - DNA, 201 bp, Homo sapiens
gtggggtggaggtgaaatcatttaaccctccttggcctttgtttcctcacctataaaattagggcactagagaaatgatgtctgtggtttccatcagttcsctccctctagctttaaacactataatttgcttttctctgctatgcacacggcactgtctaacattccctggggaatgatactttcagcatcgttttcaaa

SEQ ID NO: 2024 - DNA, 201 bp, Homo sapiens
tcttgcttcttactaaaaaaattttgtcctgaaaattttcgtatatactactttgctggacttatgattttggaaaatgagacagggataaaataatctasttgcatccttgctttgatttaactcagaatgtttcggttttcacaaactagtgtaaattaaagagtaagaatgtcaaacgaatgttggttgtataaaata

SEQ ID NO: 2025 - DNA, 201 bp, Homo sapiens
tacagaaatctgaaaattaggatatgccttcaaaagatttacagaatgaatatacaaattatttcaagatgaaggaaaaccatctaagattccagcctccktgaattctagaaatccctgctaatttctaacctttactcttctgtgtacctgcagctactcagtgtttcatttttgatggtagcttctttggacaattgc

SEQ ID NO: 2026 - DNA, 201 bp, Homo sapiens
gcagatttttttgtagaaatagatagtatgctgcaatttaaatgtaaatgcaaaggtcttggaaagaatttaaaaaggaaagaacagtgacaacataaacygctctagtatagacgacagagtgagaccttgactctaaaaatcacaaaaccaaaaccaaaaagaatggccaataaacatataaaaagatgctgcgcatca

SEQ ID NO: 2027 - DNA, 201 bp, Homo sapiens
gcagagtagtaataaacaacaaaattagatggaagaaaataaaagcaacgtgtttttaaatgtggcagaaaattctgatgtagttttcttgctaatcaggrccgctagcagcttttattttcctaggctgaagcgtagttcaaagggtacattttgattctggctttgctggtttttcgagattttaaatgtcttcttgtt

SEQ ID NO: 2028 - DNA, 201 bp, Homo sapiens
aaagggatgagaaaaaaactaagtatacatccataacttattacatatattgtgcatgcatgtgcacacacacacacaaacatacaaatcagtttgatccygcaagtggaagcaacttcattagaatacacctgtatatttgtatgtgtgtaaatatataagacagaattgcttttatttcatacatgacataatacttgg

SEQ ID NO: 2029 - DNA, 201 bp, Homo sapiens
gctacaactatatacttcctggcacgatgagagaatttctttggattggcaaagatgtggagcaattggaagtctcattcattccttgaggaagcattaaratgtgcaactattttggaaaatattttggcagattcttttaaaatgaaacatacacttaacatatgatcaagcaaacctactcttacatatttaatcaag

SEQ ID NO: 2030 - DNA, 201 bp, Homo sapiens
tgtgccattttaagttacaacagcatttcatgagaatttcagttgctgttcattctcaccaactcttagtagggtctttttaattttagtcattctattasgtgtgtagtggtatcttattgtggtcataatttgcatttccctagtgcatgttgaacatcttttcatgtgcttatatcttctttggtgaagcatctgttt

SEQ ID NO: 2031 - DNA, 201 bp, Homo sapiens; identical to SEQ ID NO: 1345

SEQ ID NO: 2032 - DNA, 201 bp, Homo sapiens
ttacagttttgtaaactaaggcttggagagaagtggcttcttgattccaggcagacataatttctattttctcctagttttattatttgcctatagcaccrtttctctaaaagacttttattcctaattgttataaaattctagctcaaaatttcttatcatattccccaacccaagaatgcatagtaagttcctactcat

SEQ ID NO: 2033 - DNA, 201 bp, Homo sapiens; identical to SEQ ID NO: 1348

SEQ ID NO: 2034 - DNA, 201 bp, Homo sapiens
gaaataatacattgtatgaatttctgttaggaagaaatattgatatttcctggaaagtgctgaagaaaaaaatacttttataattttgatgatgacacaayagaagaaaaaacagtgctaatttctaaactgctaatttctgaatcagtttatcttgtcacctatttgattttcttggtctcagaccaggcacctatttga

SEQ ID NO: 2035 - DNA, 201 bp, Homo sapiens
atccatgtaccttgggaatctggtactggtgcttgagtataagctttagtgtaatgtggtaattaccttgggcttccaattttttttattaatgaagaagktagaataattaaaaagaaggaaaatatctctctaccaaatacacttggtgaaaaaataactatcaaaattacaggctataacaccgtaccatcaaaatcc

SEQ ID NO: 2036 - DNA, 201 bp, Homo sapiens
ttctctaattctgaaacactaattctgaaaattgagccagtcataacaatttaattacacacacaaagggagcataacctcaagttaacataaaattataygattggactaacatgcagttgttaccgcaattatccagtctgacactgtgcattattgcatttcacattgtattaatatgtataaaagacagagggtcaa

SEQ ID NO: 2037 - DNA, 201 bp, Homo sapiens
ctggaagtaatgttttccaaaacctcaaggtgagaactcagacaagctaataccttgttgtcagtcttgtgataccctgaacagagaacccagtcatataytacctgaaatcctgacctactgaaactctgagatattaaacaggtgttacttaaattttctaaatttatgttaatttgttaagcagcagaagacaaccaa

SEQ ID NO: 2038 - DNA, 201 bp, Homo sapiens
taattatccagaattccttcctcattgttatgcccagagacttctattaattagctaatagcctgggaattcatttaaggggtttatttacctgatataaraaaagccacgcaactcagtattaatcttttctccatgactgtatcatatctgatgactttaaattgctcttaagacaagaaaaacagatcttacaatgcc

SEQ ID NO: 2039 - DNA, 201 bp, Homo sapiens
tagcaagatttgggaaattttcttgaattgtttcttcaaatatatttcccagattgataattttttctccttctttctcagcaatgccaataaatcatagrtttggttgctttacataattccatacttctcaaatactttattcatttttaaaatttcttattttctttatttttgttgtactggcttagtttgaaagac

SEQ ID NO: 2040 - DNA, 201 bp, Homo sapiens
gcatttgagaataatgtatgttatattgttgttaggtggagtatttcatatatctctgttagatttctttggttcccagtgttattgcagtcttttatttytttgtttattttgtttccagttattcaattatttaaagtaggatattaaagtctgtgttattttcaattcttctatttctccttacacttctgtcagatt

SEQ ID NO: 2041 - DNA, 201 bp, Homo sapiens
agcatcatgctgcccaacttcaaattgcactacagggctatagtaatcagaacagcgtggtactggtacagaaacagacacatagacaaatggaaccgaawaggcagcctggaaataaggctgcatacctacaaccatctgatctttgacaaagctgacacaaacaagcagtggggacaggactccctattcactaaatgg

SEQ ID NO: 2042 - DNA, 201 bp, Homo sapiens
gttaccagccaccacaaaaacacacttaaatacatagaccactgacactaaagcaacctcacagtcaagtctacataacatccaattaacaacatgctgtyaggatcaaatccatacaaatcaatattacctctgaacataaatggtgttcatagtcttaacgtgactatttaatccctcagctcttgaattgttttactg

SEQ ID NO: 2043 - DNA, 201 bp, Homo sapiens
tgatgtttagcattttttcatatgcttgttggccttttgtatgtcttcttttgagaagtgtctgttcatgtcctttgctcattttttagtgaggctgtttkttttttgcttcttaatttgtttcccatagattatgaatattagaactcattgaatgcagagtttacaaatattttctcccattctgtaggttttgtgttt

SEQ ID NO: 2044 - DNA, 201 bp, Homo sapiens
tgtcgcccaggctggagtgcagtggcatgatctcggctcactgcaacctccgcctcctgagttcaagcgattctcctgcctcaacctccctattagctagractacaggtgcgtgccaccacgcccagctaattttttgtatttttagtagagacggggtttcaccgtgttagccaggactgcagtgtcaagtttgagatg

SEQ ID NO: 2045 - DNA, 201 bp, Homo sapiens
cactgcactctagcctgggcgacagagtgagactctgtctcaaaaaaagccaaaaaacagaaacaaaagtaaaagcactcatttattattcaaaacatgtkcaagagtcctggttcaaaaataccatgaagttggtgcaaagagaagtttaaagtgttgaagtgaagcttgaaataataaaattttttaaaaaagatagaa

SEQ ID NO: 2046 - DNA, 201 bp, Homo sapiens
aagtgttgtattcaggtcctcaataactcaccagtaatattgctaggtagtaaaaatagtatgtacagaaaggcttagacttgtagtgatccaaggtcagkgcagtaggagtgacccttccagggtgcaggcaataattcaaacgtgaagacaataacaattaaactgatgaagattggtcagttttctgtcactgtaagc

SEQ ID NO: 2047 - DNA, 201 bp, Homo sapiens
gctatatctttactaatttttcggctgcttaatatatcaagtactgacagagatatgttgaagtcccctgttataattttggatatgcctatttttctctrcaggtctaccagcttttgccttatgtatgttgatctgttgaagtacctacatttttaggattgttgtgtcttctaggagaatagtcctttatcatcatat

SEQ ID NO: 2048 - DNA, 201 bp, Homo sapiens
cagtcatatactacctgaaatcctgacctactgaaactctgagatattaaacaggtgttacttaaattttctaaatttatgttaatttgttaagcagcagwagacaaccaatataattcgtaaaatttgcttgataggtcgatgaaacctcctaaccctttcaatgagacagttttaagaacactgacaagacaagtaggc

SEQ ID NO: 2049 - DNA, 201 bp, Homo sapiens
actcaatttttagtaccttttttgtggcttccttaagattttccatttataaaaacttgttactgcaaaaaagaaaaataaaattcacttcttttgacaakctgtataatatgtaattatttgtcaaattcatttttgctaagtacactgggtaagacccctttacaatgtcgaatagcagcagcaagtgttgacatcctt

SEQ ID NO: 2050 - DNA, 201 bp, Homo sapiens
aagcatagcatcaacaaaacaaaagaaaacaaaaccccaagcaagccaaaatgcaacgtaataattactattggataccaatatccccgcccccctctccytacacaggtgctcactgactccactcttttcttagatcttgatcaattgctattttcataggtcccttatctttctaaaatttttgcaaatctattctct

SEQ ID NO: 2051 - DNA, 201 bp, Homo sapiens
gtgctcatatgtggttttgtcttgtattacggtgaaaagcatcagtgatgaaaatagatgtgttttagtccactcacattgctataatgggatacttgagkttaagcagtttaataagaacagaggtttatttggctcactgttctgcagactgcacaagaagcagaggaccagcatctgtttcttgtgagggcgaccaga

SEQ ID NO: 2052 - DNA, 201 bp, Homo sapiens
atgcctatgaccttttaaaatttccaaacagttttatgcttcctttagcttccgcaaccttgcaaatgccactacactttacctatgatattctcctctamtttcctctagttagtgcatccttcaggtctcaagtttaagtcatttccatgtatgacatcatgtttccatattgtacgtgtcagagcactcttctacaac

SEQ ID NO: 2053 - DNA, 201 bp, Homo sapiens
atggtaattctattagttttttgtgaaatctccaaactgctttccacagtagctgaattagtttacattcccaccaacaatgtagacatattccctttctmttctgcctcaccaacatctatttcctgactttttgataacagccattctgactggtgtgagataatatcttattgtggttgtgatttgcatttctctgat

SEQ ID NO: 2054 - DNA, 201 bp, Homo sapiens
gtgagccgagattgcatcactgcactccagcctggtgacagagtgagactccatctcaaacagacaaacaacaaaaaagaaccaacttttgggttcatcarttctttatatggattttgtttccccattttattcagttttgctctcatgatagttatttcttttcttcactagttttggggttaatttcctcttgttttt

SEQ ID NO: 2055 - DNA, 201 bp, Homo sapiens
ttcaagtcaagaaaatatgtcatactcaagtaaatatgagtaattaaatgtgattaagtgtaagatgtaaattatgtatctagagagaaagctagaaagayaggaacccagtaggggtgttgttacaaacaggtagtttagacagttcctcttaaaagagtttcactttgttacaaacaaggtgttcttctccaaaaggtc

SEQ ID NO: 2056 - DNA, 201 bp, Homo sapiens
ggattacaaatttcaccagtaccacactccacacatttcactttattttatttttatttttggcagcaggagtggggtgtgtgtgggggacagggcagtgrggttggagtgaaggatagggaattagaggtcgatgcaaaggtgacatgttttggaggtagaactctgagttatttatcagcctgagtggcagcttgccct

SEQ ID NO: 2057 - DNA, 201 bp, Homo sapiens
ggttatttgtttttattttgcaagtgaaaaagggactgactttcctgaggtcccttgatattatcaggaattctataaacgtaggacaaaaaggaaaaaargcagtgataacaaaaacaagatcaaattcatgatgaatttttgagcaaactacataacctaaaatacataaagcagacatttctagtattctagaagaaa

SEQ ID NO: 2058 - DNA, 201 bp, Homo sapiens
ttttaaaatataagtgggtccaataaaatgttaatgaataacaaaaatcagagcctaaataaaattcaatttattaaaataggtttttaaatttttgatgrgtgttgaattaatcatgagtttttcatccaggtcttttattttgagaaaattacaaaattttataaaccggatctctcgtcttcaattatttgttcccca

SEQ ID NO: 2059 - DNA, 201 bp, Homo sapiens
agatgattccttcgtgttcattatcatctttttctttcagatgggagaattccctttagcattttttgtaggacaggtgtgttgatgaaatgcgccagctkttgtttgtctgagaaggtctttgtttctcctttatgctaaaaggatattttcaccagacatactattttagagtaaatttttttttctcactttaaatat

SEQ ID NO: 2060 - DNA, 201 bp, Homo sapiens
tcatataatccccatgtatcgtgggaggtaatttaatcgtggggacagtcaggctcaggctgttctcgtgatagtgagttctcacgagatctaattgtttyatatggagctatcccccattttgcttggcacctccccttgctgccatcatgtgaagaaggatgtgtttgcttccccttccaccatgattgtaagtttcct

SEQ ID NO: 2061 - DNA, 201 bp, Homo sapiens
gaagtactttgaaatgtaattatatctccttctattggaaattgtgatataaatgttccaattaaatttaattgattttacttctattaaaaaaatcagayatataattaattatgttatagacttaatatagccatgagaccatattatgtatctgtattctctctctctctcaaatgctttcttaacagtattttttat

SEQ ID NO: 2062 - DNA, 201 bp, Homo sapiens
aacctcatgtgctccatgctgaagatgtcaaggaggcccattagctcccaagatcaatgtctctaatttagcctacggatcaaggagttataaaaaccttwaggctcattacagaaggtactctgcggaagactgacaacgctatggaagagaaccctaacagagaaaacatcatgaaagtctggaaggattgcccctttg

SEQ ID NO: 2063 - DNA, 201 bp, Homo sapiens
ggtggactatctttgcatagtatgttaactccagagctgttttcttgtgataagtgtatactttctaaaaactgaagccaaagttgatgaaaacgatgagraataaaatatcattccagtgtcaatatctaaaggcacatccttcatcagaattatattttaaatatccatgaagaaaaatatagagacttacatatgtat

SEQ ID NO: 2064 - DNA, 201 bp, Homo sapiens
aagttctatcatgtgattgctgcaattcagttgcatcttcagactccacttttaattctttgtcttcctattttcactacatctgtagttacttcctcatstaaaattacaaacccctctatgtcatccatgatggttgaaatcaatttcttttaaactcttgttaatgttgctatttgacctcctcccatgaatcactaa

SEQ ID NO: 2065 - DNA, 201 bp, Homo sapiens
tttatgctgatttgagggagacgtaaagtcaaatgtaattgtagcatccagcaagaaaaagggctgagaaaaaacagtgcactgaaaggcgtgtaccaggwaaccacaggccaaccactagtttaagctgtgactggaagcattgcagaaggctaatgaaaaaagactgacctctgggtaatccaccacgtacctaacctc

SEQ ID NO: 2066 - DNA, 201 bp, Homo sapiens
tgcattttgactttttgttatctcaattaatatatctttaaattacctatctcttgacagttttctgtagcttttactgttttttatggctttgtcttgtrcacctcatactggagttataagaggatttcataccacagttgcaatgttagaatattccgggtttgtctgtgtatttacttttaccagtgggttttatac

SEQ ID NO: 2067 - DNA, 201 bp, Homo sapiens
ttatagtataacttgaggttgggtaatgtgttgcctccagaatctttttgcttaggattggtttggttattctagacttttctggttttgtatgaattttkcaatagttattttccaattctgtgaaaaatgttgttggttgtttgatagaaaattcattgaatctgtagattgctttgggcagtatgatcattttcatga

SEQ ID NO: 2068 - DNA, 201 bp, Homo sapiens
gctgttctttagaacatttctgtcttgaggctcttctgatgcttcctgtcggttgagggaggaactggtttcttgccaggaaatcccagatgatgggaagkctggttgtccacatcactattgctgttttcagtatagacaccatgagtcagagataaattttctgcacacttaatgctgggcagattgaggggtgggaca

SEQ ID NO: 2069 - DNA, 201 bp, Homo sapiens
agaggctgaggcatgagaatagcttgaacttgggaggcagaggttgcagtgagctgagatggtgccagtacactccatcctgggtgataaagcgagactgycaaaaaaaaaaaaaaatgttcggagaattcagcagtgaagacatcgggtcccgggcttttgttttctttaccaggagcctttttattatgactttgatct

SEQ ID NO: 2070 - DNA, 201 bp, Homo sapiens
tttttatacttattaaactatatcatctaatacctattgtctgattcctgaaaaacaatcatctcagttattttattgtttctagtttttagatttttggrttgtggttgttgtgctttgtttgttttttagctggaagcccagtctgggacaaggtcctctgtcatagcatgcaatggatttatagttattaaactccaa

SEQ ID NO: 2071 - DNA, 201 bp, Homo sapiens
gtgacaaatttccttttctctccagaaaccataactgcattgtccctacatgatgtggaacactctattcagtagcttctcatatgtgtagtctctttctragcttgcccaaatagagcctgtctgattactgaatgagataacatcgtctttttttgctgtcttttatcttttaggcttcatctttctctagtaatttat

SEQ ID NO: 2072 - DNA, 201 bp, Homo sapiens
tcaccagcctcatcaaaggtttgtaccatttgttgttcctcagactcattccctgtggctctctcacctactgctccagctgggcccttgcatgatgtgamaccacattttataaggtgcaaagtttctatagtcaaccagttggcaggagggaggcagttattacatttgtttcctccttctcctgcactttgctcaaaa

SEQ ID NO: 2073 - DNA, 201 bp, Homo sapiens
caaaaagtgtgaacagctattattgtcatttaacaattagtggagaagccagcagactttgcaagatcattgcccgtccatgactggcctttgtctataamtggcaggatttctcatgtgtcagctgcagtatttagatttggttggagagctgggcagtgtggctcagctgaagtcaagagaaaccccgaacttggggaa

SEQ ID NO: 2074 - DNA, 201 bp, Homo sapiens
ataatatagcccacttcttgattcaaccatgaaaaatatttgtatagccagaatgaaatatggactgtcaatttaaccaaacattgtgaaataactatatktggaagatgcaagagacaaaatgagaaggagcattagtatatgaaaactaagtccttatctaccatggtgggaggttagtagaaaatggctaaaaatgat

SEQ ID NO: 2075 - DNA, 201 bp, Homo sapiens; identical to SEQ ID NO: 1109

SEQ ID NO: 2076 - DNA, 201 bp, Homo sapiens; identical to SEQ ID NO: 1110

SEQ ID NO: 2077 - DNA, 201 bp, Homo sapiens; identical to SEQ ID NO: 1111

SEQ ID NO: 2078 - DNA, 201 bp, Homo sapiens; identical to SEQ ID NO: 1112

SEQ ID NO: 2079 - DNA, 201 bp, Homo sapiens; identical to SEQ ID NO: 1113

SEQ ID NO: 2080 - DNA, 201 bp, Homo sapiens; identical to SEQ ID NO: 1114

SEQ ID NO: 2081 - DNA, 201 bp, Homo sapiens; identical to SEQ ID NO: 1115

SEQ ID NO: 2082 - DNA, 201 bp, Homo sapiens
cagcagtgtttacagttaacgtggcaactgtttccttcttgttaaatttctctcatctacgttggatggaccacagtatattcatttgttctccggctttrgagttctctaggaaaatcaagaggttttcttagctccatggccatccaggggtgaggggctcctcacaggggcacagacgggactcagggaagatggcgc

SEQ ID NO: 2083 - DNA, 201 bp, Homo sapiens
agggtacagcctccctcctggttgttttcatgggttgaagttgagtgtctgtggcttttccaggtgcacagtgcaagtgtgggtggatctgtccaactgtyggtggacctacccttctggggtgtggaggacagtggccctcttctcacagctccactaagcagggccccatagagactctttgggggttctccgactcca

SEQ ID NO: 2084 - DNA, 201 bp, Homo sapiens
ggcatttttaaatccttggagtaatatagcatagtaatattggaaaattgtcttagcttttggatcatgccatttaaaggcaaacaggaattggggttttytttaactggtatgcagaagacagtatctttgaagtctcatactgagaaccagccataatctcctgggataatagtgacttgggtgtatgggttatgtact

SEQ ID NO: 2085 - DNA, 201 bp, Homo sapiens
tacaggaattttccaggaagttcaagttggaggtttctccacctctaccaatgagcttgtatgaacctaaaatcatgtattagattgctttttgcaccaamcgtctagagtagattccgttattggcatctacaaaccactaagtaaaataaataggtaaattagagatgggaaacagtcattctaggacatcagtttctg

SEQ ID NO: 2086 - DNA, 201 bp, Homo sapiens
tttgaagtaacagatgaacattatattgaaatagatgaaaaacgtcgaggagaaagttggaagtataaaaaaatgaaaattatagaacttgaaaattcccrgtattttttagaaaattatcagataggcataaaaagtagatgggatactttagaagaaaacatctgtaaactagaagatgggtcaatagaaaatgttaaa

SEQ ID NO: 2087 - DNA, 201 bp, Homo sapiens
ttcacatcatcataaagtcaaaaaattgttaagccaaactatcttaagtcagggactgtctgccttttattttcattagactcactaatcaaaaaggcaarcagggcccataggaattatatccattcctgttgctgttgtaacaaattacccacaaatctggtgccttggggtaacacaaattggttctcttacagttct

SEQ ID NO: 2088 - DNA, 201 bp, Homo sapiens
ctgatatagaacaggtgcatggaaacgtccagcatagagaaatctacagaaacagaaagtagattagtggttgcctaggcttgtggatgggagggaagatrgggagtgacaactaacgagtatggatgggtgttttggtggggccattgaaaatgttctaaatctattgcggtgatgtttacacaacactgtgacgatact

SEQ ID NO: 2089 - DNA, 201 bp, Homo sapiens
tacagccttgtggtaggtggtgggctaaggtgtctgactattttagggtcatcatttagcaagtccaacacagcttctctgatctctcttttaaacatggraagaagtatcctcttttgttctcagctttggagtttcaactgatagtaaaggtgcaggaattgcaggcctgatggttgaacagctctggacaaatttcga

SEQ ID NO: 2090 - DNA, 201 bp, Homo sapiens
cacacccatcatttatatatcaagatgcctcctgttgcatttttaattttcacacatttccagttgagaatcaggcactgactctagcaacccatgaactsccagaatctgagatcaagttttccaagtgatagggttgaagctctcttgttgttttgaggtgactaggaagcacatttcccccctttctatagagctgga

SEQ ID NO: 2091 - DNA, 201 bp, Homo sapiens
ttgcaaacatttcatgtcccgctacttggggacctccctgggtcaatgtggcttataaggagtatacatacacatgcttgcccatctcacacccatcattyatatatcaagatgcctcctgttgcatttttaattttcacacatttccagttgagaatcaggcactgactctagcaacccatgaactcccagaatctgaga

SEQ ID NO: 2092 - DNA, 201 bp, Homo sapiens
ggaattgcaggcctgatggttgaacagctctggacaaatttcgacagccatcacagcagactagaccacagacctttggtaaactaccagactgccagcayttgaccactcagccacctttaagaataagcatccaaaagagtacttcatgcatttgaatggtgataaagccagatgttctccttatgtaaaagaaccaat

SEQ ID NO: 2093 - DNA, 201 bp, Homo sapiens
tggtgagcagtacttgaacaaatcatcagattcactccaatttcttataaaatgtagagcccattaatgtagatttctattttgttttccttaaataaagrgcaaacaaagcttacttctactatcagcccaatttgtttctccatcatgtacacggtcgtcttgaagtctcaaactatagtaaacatgcaatttggcatt

SEQ ID NO: 2094 - DNA, 201 bp, Homo sapiens
agaatgcaagtcaggatattcagcttttatttcttatccaagttcacgaaattaatgatgattgtatccacgagagccaatgaggatcactgttgacactmttggtagtggcttacctaatataaaaccttttattctcgttgtgtttattgacagtaagtcactgagttagttcgggtcctctaagaagcagacactaag

SEQ ID NO: 2095 - DNA, 201 bp, Homo sapiens
atgagttttatatttatactttggcaattgttctctgagcaggccaagaacattctatttagccattcatagtatgtgcttgatatttatgaaccaaatcragggactcatgtaatgcaggtgacttgataaacatgtggcctatatgaccacagacttttaaatgtagcttcagatgttaaagaattactaacttcggaa

SEQ ID NO: 2096 - DNA, 201 bp, Homo sapiens
tattcttggaaacctattttgaagtatcttacaaactttgtgtatatcaatctgctctcctaggaaatgatttcaaattgtaggcttcaggataagcaaaraacatacttcaaaaataaaaattatcttcctaccagacaactgcttttgcaattcgtgcaatagccaccttcctggtcctcttttcttcagttcacacag

SEQ ID NO: 2097 - DNA, 201 bp, Homo sapiens
tgttagggcagaggtgttttctttctcttgaactagttaggaacaagaaaatatgtggctttggttggtgctggtaactatcttaaagccatgcggcttgraactgccttaaactgaagctgctaatggcagaatggtgacaccaaaagagctggtacttaatgacagagtagaacagacagattattcaaccctagacta

SEQ ID NO: 2098 - DNA, 201 bp, Homo sapiens
gaaaattcttgctatccctcaatgaaatgagttttatatttatactttggcaattgttctctgagcaggccaagaacattctatttagccattcatagtaygtgcttgatatttatgaaccaaatcaagggactcatgtaatgcaggtgacttgataaacatgtggcctatatgaccacagacttttaaatgtagcttcag

SEQ ID NO: 2099 - DNA, 201 bp, Homo sapiens
atgatatagattttattgaatccttttatttaaaaattcttaccatgtatttttattgaccttagtattacaatgaaaagccttgtttattgatattagcytatgcatcatagtgaaaatattgatcataagatttttaattatgctaaagtaaggatattttgtgaaaactctgaaattatatagaaatattggtgtatg

SEQ ID NO: 2100 - DNA, 201 bp, Homo sapiens
atttctatttgtatctgaatagatttatatccaaatttggagagaagcccatgttccattaccatgcaaaccacaacatgcttgagattgctaattagggkacaaattgtggtggtatttctggtgacctggacatgtgttcaatagaaacagaaatgagcccctcaactcatttcacataggccagaaaacatctgccag

SEQ ID NO: 2101 - DNA, 201 bp, Homo sapiens
aacaagtcagcaggacacaacttactccttggcttttttacatctcagtcgtcctgcgtgtaaattacggttactaatgattcctcagatcactgatctayggaacaacactgatcaagcatcctaaaattcttggttagctgtaaattaaaagaaaatttctaatgacacatttttttcttatgaaataaatgtattttt

SEQ ID NO: 2102 - DNA, 201 bp, Homo sapiens
ttatatatacacatataatatacaatatatgaatatattatatatacacacatatggatatgcattatgtgtgtaaatattatatgtcatatatattatgrgtgtgtattcaaatgcaaccacaaaataatagttacctataggagaagaggaaacagagtgcaggagcaggacagaagggacaggatatcagctagatgt

SEQ ID NO: 2103 - DNA, 201 bp, Homo sapiens
atgttcatcaacacatgaatggataaacaaaaaatggtatatacatacaatggaatatgatccatccttaaaaaggaagagaattctaacacaaactacarcatgggtcaaccttgaagacattattgcaaagtgaaataagtcaatcataaaagaacaaatactgtatgattccacttatatgagatacctagagtagcc

SEQ ID NO: 2104 - DNA, 201 bp, Homo sapiens
aatttctacaaggcaagtattactatatgcatctgatagatcaggaaactgaagctctggaggttcaccaacttttctggtgccagtctaacttcgtaagrtaggagagtataaagtcagacttctatctcgatttcatatatgattttatgtcagctctgatgtattctcaagtctgacgcttaactgctttttttcccg

SEQ ID NO: 2105 - DNA, 201 bp, Homo sapiens
agcacttgaggctgggttagagtttacattgtgttataggtaatgctaatagagccattgtagactttcaagctagagaatatcaatatttttattcgtgyttttaaaaggtcaagctggcagcattttggggaagaaccagagggtagagagcataacatgctttaggcagctactgtagttgtctagattagagcatat

SEQ ID NO: 2106 - DNA, 201 bp, Homo sapiens
ggatgagaagttatcctggcaaaagatggagaaaggagcattttaaagaggggaactagtttaaaacaagattctattttggaaaaagcataacatgttcrataaaattagagcaattttctggagcaatgttgcttaaactcagagagcaggagaaagaatagcatgagctggaaatggagataggcagggccaaagcac

SEQ ID NO: 2107 - DNA, 201 bp, Homo sapiens
gcactcaggtcagactagccctgtctgatgggcaagaccaccctgcagagttcaggcctgacatttccctagggctaaaatcttctatgggagcaagtcargcctagaaggatggccatccctggccatgttctgctgcaaatactcctgcaccaaacactctgggctccacatcagctgacttgctccccctatgacttc

SEQ ID NO: 2108 - DNA, 201 bp, Homo sapiens
tctctcttctttattagtctagctagcactctatcttattatcatttttcaaaaaccagttcctggaattgttgatattttgaatggtttttcatgtcccwgtctccctcaggtcagctctgattttggttatttcttgtcttctactagttttgaggtctgtttgttcttggttctctagttcttttagttgagatgtta

SEQ ID NO: 2109 - DNA, 201 bp, Homo sapiens
caaaggcacaggagtgacacggaacccacattcagacaactgctagcaggtctttgaggctggagtcagatgaaaaggcaagatgcaacaataattctttktaattttatttgtggggagaaatgaatttcaagttacaaatatctattcacaatcaacaaacttgcaactaactaccttataagttatattaccttatga

SEQ ID NO: 2110 - DNA, 201 bp, Homo sapiens
gagacattgaatgtgtacatgagttgggagaacattaggagactagcctggtcagagtaatgtttgcaggttggtggatctcctgtatagcctgaatcatyttctatgttcaagaggctgtgtcctgtgtggtagcactgcccatctatctctagactcctctgtcccatgctaatcctgaatatcactgctaatatgtat

SEQ ID NO: 2111 - DNA, 201 bp, Homo sapiens
caccgtgggagaggccagctgggcaagtctgtccttcggggaggtctggggtgtttggggaagggagatagggacacacaatcctcacaacaactgcaaamagaagtgtgagcacgtgggggcagagggagcgtcagtcagacgggaggtgatcgggactggagagagatgtcccagaggaggtggcttgggcaggtgggc

SEQ ID NO: 2112 - DNA, 201 bp, Homo sapiens
ctgcatctgtaaaagataacaggtgtacatttaaagaaaggaattcatacatatttaatgatttagcttaagcaactgggcaaatattcattttcttaagrtggtaatacataattaactgataataaaattaattgggtaaaacagtctaaaaataatgcagtacttattacatgagggaatataactgcattgaaagag

SEQ ID NO: 2113 - DNA, 201 bp, Homo sapiens
tgtctcgtttttaccattggcttggtttactaattttcgtcactaatttaactacaaactctttctttcagaattttgaacatattcctccatcatgttcyggttcccactgacgctgttaaagaatccagtgccattcggatccatgatcctttgtatgaaatccactttttctctgcaaacttgtaggatattttcttc

SEQ ID NO: 2114 - DNA, 201 bp, Homo sapiens
aataatgcagtacttattacatgagggaatataactgcattgaaagaggtttaattgttccagagactgatgagtccccaaaagcagcaaagggaagaggkttttccacctttggaataagggctctgagtgggcgcttcctgttcaccctgtgggaatagggtgggaatggagggtggagaggaagatggtttcttgcaa

SEQ ID NO: 2115 - DNA, 201 bp, Homo sapiens
gtttttccacctttggaataagggctctgagtgggcgcttcctgttcaccctgtgggaatagggtgggaatggagggtggagaggaagatggtttcttgcmatttaacagcttcacaacgggtttagagagcatcccaatgtctactcccaaccctaaccacacatcttcacccctgccaggtcaaaaaatacagaaaaga

SEQ ID NO: 2116 - DNA, 201 bp, Homo sapiens
tggaataagggctctgagtgggcgcttcctgttcaccctgtgggaatagggtgggaatggagggtggagaggaagatggtttcttgcaatttaacagcttmacaacgggtttagagagcatcccaatgtctactcccaaccctaaccacacatcttcacccctgccaggtcaaaaaatacagaaaagaaagaatctaccac

SEQ ID NO: 2117 - DNA, 201 bp, Homo sapiens
gctcccacttacatgagtaaatatgtaaatgtcagtgggtatttgcaaggatatttaccacaatttgaccaatggttattcctgagtagtagaattatggrtggctttttctattttctttttttaatgaaaaatgaataaaataaaagttgtcctgctagggctaccataacaaaataccacagactggactgggtggct

SEQ ID NO: 2118 - DNA, 201 bp, Homo sapiens
ctcatcagggccaggaggaagcgtggacatcttccattccatggatctgcttagcatttgacaggtgaggcccaaagagaaggcatgggccaggacccctyagggcagctgggggcacaccaggaattctggagtcagggctctatgccctccatgcccagtgggcaccgttctctaggtggtgccccagcccggtaacta

SEQ ID NO: 2119 - DNA, 201 bp, Homo sapiens
gtccagtggctagaacctggtcacgcggccactcctaactgcaagggaggctgagaaatgttacctccttccgtgcccagcaggaaaaagaaacaggtgaygttgcagcatttcttgcagaataccccactgtcgtctctgggacttttgttgacaaatcactgatgttttctgcacatcctgatttgcagcaggcagtga

SEQ ID NO: 2120 - DNA, 201 bp, Homo sapiens
actatataaaaacaaaaaaatcccttatatcaaaaaagaacattgaaaggagaagggcccactgtgggggaaatatttgcaatgtgtgatagagaatgagyaggcttgctatttaaagagcccttacaaatcaagagtgaaaaaggtgaagaaaatggacaaataacagtaacaggaaattaataaaagaagaactaaaaa

SEQ ID NO: 2121 - DNA, 201 bp, Homo sapiens
accctgtctctactaaaaataaaataaaaattaaaaaattagttggtcatagtggcacacacctgcggccccagctactcgagaggctgaggtgagaagaygccttgagcccaggaggtggaagttgcagtgagccgtgatcacaccactgcactccagcctgggcaacagacagagaccctgtctcaaaaataaaaagaa

SEQ ID NO: 2122 - DNA, 201 bp, Homo sapiens
caggagatcctcccacctcagccttccaagtggctggcactacagttgtgtgccactatgcctgactaattttttttaattagagatgggggtctcactayattattgcccaggctggtcttgaactcctgggctcaagagatcctcccactttggcctcccaaagtgctggggttacacatgttagccaccatgcccacc

SEQ ID NO: 2123 - DNA, 201 bp, Homo sapiens
tcctcccaccttggcccccaaatctgtgggctacagatgtgagccactgcacccagcctcgaggtttgtttcttaaactatcaccctccaggggctgctcygtattcatgcaccttcatgcatttggctctgggctctacccacctcccctcaccccagattctgccaagctggtgcttaggacagtggccctcccactta

SEQ ID NO: 2124 - DNA, 201 bp, Homo sapiens
gtgggtatttgcaaggatatttaccacaatttgaccaatggttattcctgagtagtagaattatggatggctttttctattttctttttttaatgaaaaaygaataaaataaaagttgtcctgctagggctaccataacaaaataccacagactggactgggtggcttaaacaatagaaatttattttctcacagttctgg

SEQ ID NO: 2125 - DNA, 201 bp, Homo sapiens
tggaagttgcagtgagccaaaatcgtgccaccgcactccagcctaggtgacagagctagactgtctccaaaaaaaaaaaaagcagattgcgtagccaggtrtggtagcacacacctgtaatcccagcactttgagaggccaaggtgggaggatcacttgaggccaggagttcaagaccagcctgggcaacatagcaagact

SEQ ID NO: 2126 - DNA, 201 bp, Homo sapiens; identical to SEQ ID NO: 1084

SEQ ID NO: 2127 - DNA, 201 bp, Homo sapiens; identical to SEQ ID NO: 1085

SEQ ID NO: 2128 - DNA, 201 bp, Homo sapiens; identical to SEQ ID NO: 1086

SEQ ID NO: 2129 - DNA, 201 bp, Homo sapiens; identical to SEQ ID NO: 171

SEQ ID NO: 2130 - DNA, 201 bp, Homo sapiens; identical to SEQ ID NO: 1088

SEQ ID NO: 2131 - DNA, 201 bp, Homo sapiens
cattctgttatcaaagtgatgcttccttgctcacaagaatgcctccaggccagcaacgcagatcttaagcagaggtgaaaccacatcctcccaacttctgsttgtccggtgggatcagtgcacagctgaatagggtgagtatgagaggataaagatgcacaaagaaaagagagtagggtctggtaggtgctccaggataag

SEQ ID NO: 2132 - DNA, 201 bp, Homo sapiens
agtctctaaaggcagcaggtgggagccagttgaatggtagacaccccctaattctgggctgtgcccatgctgccaactcctcaatattatcatgaagaggrcgaaaagaagaaaatacatttggcagtttaaatcagataattattttttaaaaaggtatgctgaatataactcccaggtttgatccatctgtttaaactt

SEQ ID NO: 2133 - DNA, 201 bp, Homo sapiens
taatcactctcccacttttcagcaggacattggtcaagacttgagtctcctttgccttagggttcacccacattctctctgcttcctgggtgggatgccargagagaattaactatctaaaggctaacttatcttaagaaaaaaaaatgcatcattcagaagaggttttgttgactttcagaaacattgaaggtgtgtcct

SEQ ID NO: 2134 - DNA, 201 bp, Homo sapiens
ggtaatcacaagttcctgttattgatgcctgtgcagtggcctgtggggagatggatggcttattttttattgaattttgccgttatagccaaacatcacaytggcagtgcaacttcattgaccttcaccctcgaattcgaggaaggaaggtcgaggtgtaaacagaggatggagactaaataaggtagttgtctcttgaat

SEQ ID NO: 2135 - DNA, 201 bp, Homo sapiens; identical to SEQ ID NO: 1099

SEQ ID NO: 2136 - DNA, 201 bp, Homo sapiens; identical to SEQ ID NO: 1100

SEQ ID NO: 2137 - DNA, 201 bp, Homo sapiens; identical to SEQ ID NO: 1101

SEQ ID NO: 2138 - DNA, 201 bp, Homo sapiens
tgagactacaaagttccagacaaactagccagcacagaggacaataggaccatcgcctcctgtgatcgacaccccatttttgcattaatgcatcccatcayggccttgttagcaatgtgtgacgtcattgctcccactgaagctgcaagacagccacaaactccaaaacattcactctctcatatttgcacaattaacttt

SEQ ID NO: 2139 - DNA, 201 bp, Homo sapiens
tgaggtttactattgagaaccaggagggaccttcagaggcagccagccttgtgggctcaccatactcagaaagaagagtgaacactaatttagctggtgtkgccctactgctctagtcagacttcccacaacattctattcagtgaatccatggactccatgacatcactcagggaacatttggagtccccatagcctgtc

SEQ ID NO: 2140 - DNA, 201 bp, Homo sapiens
gctttcagcagcataaagcgaaaacgcaaccacaatggcttacaccacatggacattgattagtttacagaataagaaatccgagctatggtggctatgargttggctcaaagatgtcttgaacaattcaagttcgttccacttctttgcattaatcctcccagcctattgacttcatccttaaacttgttgcttcatgat

SEQ ID NO: 2141 - DNA, 201 bp, Homo sapiens
atgttaatgaatgaagtttctcaggccaagagctagtcagcagcatatgtatgtgcaaggggtcagtggtgctacagcatctatagggttggttctgcaasaggcctccttccccaagcctgcaccagccgtgggcattatcaggaggccacacgttcttttgtggccccgtgaaagaacagttctgcggccaaacattta

SEQ ID NO: 2142 - DNA, 201 bp, Homo sapiens
gtggccccgtgaaagaacagttctgcggccaaacatttacagtcattgtcatattttccaaggcaaggccatgggggctcaagtcagcaccagctctgggraggaagagataagctgaggctgaagaaccaaagtcagaaggagaggaaccagcacacgaggaaggtgaggaatggtatcttctgagaggtgtggccgacc

SEQ ID NO: 2143 - DNA, 201 bp, Homo sapiens
ggggcttctctaggagaccaggccctcgcaggaaagagaagccccacagacatggaggctggccaagctttgcccattgggcagtgctatggactgagctktgtctcccccaaaatctaagtgttgaagccataatccccagtatgacaggatttagaggcagggcctttaaggaagtaaataaggttaaatgcagtcaca

SEQ ID NO: 2144 - DNA, 201 bp, Homo sapiens
ggtgaacatttgcaggaaaaataaatccatgaatgaactgagctactctcatcttgaagctacttgtgttctcttgtgcagccattttttccatttgaaasccacctccctcacctaccccatcctacggctgttctagaagagtgagcaggtataccgacacctcacacagggcttgcacgctgcaggtgatcaggaaat

SEQ ID NO: 2145 - DNA, 201 bp, Homo sapiens; identical to SEQ ID NO: 1102

SEQ ID NO: 2146 - DNA, 201 bp, Homo sapiens
gatgctggggaaggaagagaagccaagtgtctggatggtgtgaccccagactgcaacgctagaatgactctcaaaacattctcctttatcaaggaaacaaraatgtgagtcactctcttcccgcaccccaggggtttctttgctgagcagggctgcaaactgttcagctaattaggctgcatcctgaccttagcctccatc

SEQ ID NO: 2147 - DNA, 201 bp, Homo sapiens; identical to SEQ ID NO: 1103

SEQ ID NO: 2148 - DNA, 201 bp, Homo sapiens; identical to SEQ ID NO: 1104

SEQ ID NO: 2149 - DNA, 201 bp, Homo sapiens; identical to SEQ ID NO: 1105

SEQ ID NO: 2150 - DNA, 201 bp, Homo sapiens; identical to SEQ ID NO: 1106

SEQ ID NO: 2151 - DNA, 201 bp, Homo sapiens; identical to SEQ ID NO: 1107

SEQ ID NO: 2152 - DNA, 201 bp, Homo sapiens; identical to SEQ ID NO: 1108

SEQ ID NO: 2153 - DNA, 201 bp, Homo sapiens
aataaaacctacaaaatttatgcaattttacttttactagatgctttgtttaactgttgtaaaaaatattcttatgtgccacagggtcctaactgaatgayattttttctgtaaaagttaacatagcgggttgaaaaatatgctttccataactaattaagcgtggtcagtttagaagtgtggtcactttgattagctatc

SEQ ID NO: 2154 - DNA, 201 bp, Homo sapiens
aaaatatttgtcaaagaatacaatgtctcagttctggacacctaacatacagcaaggtgactgtagttgataataacgtactgtagacttgaaatttgcawgaatatatcttaagtcttagtagcacacacacataaaaatggtaactttgccaggtgatgtgaatgagcttgatggtggtgatggtttcatgatatatcc

SEQ ID NO: 2155 - DNA, 201 bp, Homo sapiens
aacaatggctgtattgcttcagcacacaatctgtctcaagcaccagactaaggaatttacatgcattaaatcatttaatcctcagaattagcctataaggyaggtatgattaatgtccccatcttgcagatgaggaaggtgaggcacacgggaattaagtatcctgccccaagtcacttagtgagtggcagagtgagtatt

SEQ ID NO: 2156 - DNA, 201 bp, Homo sapiens
agattggctaattggcctcatttgcacaataaactattaagaactctctaataaaagtcgacaatgttgccacactttgttaaagagctaaaggttctgaratgcaatgcctatcatcactttataaaagagctgaatttgagagaaaaagctcttacaaacccttattgaaggagaattttcccaatggacacagtctta

SEQ ID NO: 2157 - DNA, 201 bp, Homo sapiens
aagaatgtgcataaaaggctttgttaatgtaaatgctcacaaatgtaagaattatattgatgagaattttatgtatagtttttaagatgctgtagaaaaaraagacatacctaccaaaaaacaggttctacattgaccttaacaaaataaatggatgtcagttacatatagctcgcttgcaccaacctcccattttcccac

SEQ ID NO: 2158 - DNA, 201 bp, Homo sapiens
cagaacccccagcattccagccccagggagttgcaagggtctctggctcagaaacagctgctgcaaaattgagcaaatttaccattcagaaacattttctyacattagaaggaaattctagatgagatataatgatgtctactttgaaataaattattgtaatataatcaatcacagtgtacaaattctaattcttaatat

SEQ ID NO: 2159 - DNA, 201 bp, Homo sapiens
tgcccactctatattggagtcaaagggtgctgcccagcttccagaacccccagcattccagccccagggagttgcaagggtctctggctcagaaacagctrctgcaaaattgagcaaatttaccattcagaaacattttcttacattagaaggaaattctagatgagatataatgatgtctactttgaaataaattattgt

SEQ ID NO: 2160 - DNA, 201 bp, Homo sapiens
caatgaagccaaaacttcttagacaccagatttccttgagaataggaccagccctcctttctaaccttttcaacctacccctttccattaaccctcatgayatcccagtcataaactcataaactgcatacccattttttactttgtcatcacgaaacattgtcaagctgaaaatcttttgtttcctacattaaaaattgg

SEQ ID NO: 2161 - DNA, 201 bp, Homo sapiens
cattatagtatcatacagaatagtttcactgccctaaaaattcagggctccacctcttcattctcccctcccctccctctgcacaagaccctggcaaatgmtgatcttttgactgtcctcatagttgtgccttttccaggttgtcacatagttgtaatcatacagtacatagccttttcagattggcttatttcacttaac

SEQ ID NO: 2162 - DNA, 201 bp, Homo sapiens
catgcttgtattttcattctcccctgtattgactgtatgttccagcagtgagctcaggctagagggaggaaatgagttgcaattgcaatagacaagtctamggttccagtacttgaaaaagagagcacaagcatatttgagatagatttggggaataaatgttcctgcaaatgggcagaacaaagaagacttagagtactt

SEQ ID NO: 2163 - DNA, 201 bp, Homo sapiens
ctagaaagcatcatctcccacttcctgtttacctcttccctatctctatttttcaaaatgttagccattttccagtggcatttggagtgtctcttaccctrtagacttttctgactacttcaagagcatttgggctgtctcttcactgaaaccccaaggctgtgacttttcttgcagcacctagattttgctttgtttctc

SEQ ID NO: 2164 - DNA, 201 bp, Homo sapiens
agctcacaggctctgcttgtaatgctcttgccacatgcccctgtctctcctttagtgtctactcttcagatctcagctcaaatgtccctttatcctgaaargtcaggctccatacatcaggtctttcttttatggtctcatagtaccctttaatgcccctccatagacttatcacaattttcaattatatatgtgtctgat

SEQ ID NO: 2165 - DNA, 201 bp, Homo sapiens
tcagcaacatcaagtattactaaagatgtggggaattcagagctctcatatgctgctggtaggaataaaagttgctgccgacactttggaaaacagttgcrcattatccaataaaattaaagaaatgcaaaaattcttacctaacaattataccctaaggtgtgtgtacaactgtctatttacaccaatgaggatgctccc

SEQ ID NO: 2166 - DNA, 201 bp, Homo sapiens
tccagttgttcacaacagtgaagagcttgataatcagctttacttagcttttcctcctttccttccactccaaaaatgccccactcttgttctttgagaamacttcccaaaataaaccaactgcatggaaacaactgtgctaggctctgtttttgtttgtttgattgaggctttttttttgtggggggcattatagggggg

SEQ ID NO: 2167 - DNA, 201 bp, Homo sapiens; identical to SEQ ID NO: 1919

SEQ ID NO: 2168 - DNA, 201 bp, Homo sapiens; identical to SEQ ID NO: 1920

SEQ ID NO: 2169 - DNA, 201 bp, Homo sapiens; identical to SEQ ID NO: 1921

SEQ ID NO: 2170 - DNA, 201 bp, Homo sapiens; identical to SEQ ID NO: 1922

SEQ ID NO: 2171 - DNA, 201 bp, Homo sapiens
catgcctggcctcagagaataatttcacattttaaactctaagtactgggtgttggctgtgcagaacctgttctttttggtttgccttttagatgccatcyttacacatgtctcttctatctggtctacctaaaagaatgcagagagaagatggaaattcaaatctaggaggatgtagatttcttaagaataagatataaa

SEQ ID NO: 2172 - DNA, 201 bp, Homo sapiens
aagaggcagaagatttgaaatagcccttgtcttagtgtcattggcagaagtgagtggggtttgcaggagtgttaagcctgttagtcattgtaaattcattrtgaacacagttagccttattaggtggttttcttcagaatcgccaggctgctcccaagccagttcctggcaaggaaatacttggttttcttggggtggcag

SEQ ID NO: 2173 - DNA, 201 bp, Homo sapiens
ctcctcatctgtcatgacaggctgataacagctgtcttgaggggatgttctaagagtacaaacaaggtggtaagttgcatgatccaccatgcctctgcctygcaggctcaaacagtcttctcaactcagcttcccaagtagctggtaccacaggcgtccgccaccacaccaggctcattttttttagctatttttaaaatt

SEQ ID NO: 2174 - DNA, 201 bp, Homo sapiens
aagaggcttccttacagccacgggattcccgcattagagtgtggctctcaccccaatactttcagtattctgggttcttacagtgtctatttctaagttcstttgttttgatggatcacggaggaaattgttttcctgtgttgacgttaaccacgcttcacgcttccctgctagccatcctcaggtgtattactactgttg

SEQ ID NO: 2175 - DNA, 201 bp, Homo sapiens
atacccattaaatcctgcaaacactgtgaatgttaattgctctgtctctgtattacggatggggagaccaaggccttggggaagacacttgtccagagatyagagctgctcaagggcagagcagtgatttgtacacaggtcttctgtgccagagggtttctcagcaccctgtgttataaccttagagcagcccactcaagg

SEQ ID NO: 2176 - DNA, 201 bp, Homo sapiens
ggaagacacttgtccagagatcagagctgctcaagggcagagcagtgatttgtacacaggtcttctgtgccagagggtttctcagcaccctgtgttataamcttagagcagcccactcaaggaaaagacatgaccatgcctgtagaggatgagaggctgaccatgaaagggcatgacttaaatgcacacatcgaggctttt

SEQ ID NO: 2177 - DNA, 201 bp, Homo sapiens
tttctcagcaccctgtgttataaccttagagcagcccactcaaggaaaagacatgaccatgcctgtagaggatgagaggctgaccatgaaagggcatgacytaaatgcacacatcgaggcttttgatcaacctcatttacgtataattgatgttccataaactgcatccagctaaatcgtacaatttcatgattttgacaa

SEQ ID NO: 2178 - DNA, 201 bp, Homo sapiens
ctccgcaggtgtgaataagtcagtctccaatgtctgggactcatattccacatctgtgaacctgagggtacccatattttccagctctcacattgttcttyctttcatttagaggatttagagaccaagcccagagtccaatacattttgagataatttaagctttctctgcctcagagaccttttctataaactaagaat

SEQ ID NO: 2179 - DNA, 201 bp, Homo sapiens
tccaacaggacgcactccttgccagtcaagacccatggtcataagatatttatagttgaggaaacagcctgaagatacctatgaggacacactcctacaayaatggagaatccagatgtcccaatacccataagaatgtatactttcaagataattatagttatgctttgatgtactcacacactaaaatgtcaaggatag

SEQ ID NO: 2180 - DNA, 201 bp, Homo sapiens
gctacagaatcagatggtgtgtctcttacaaatatactaaaaaagcagactttctaatttaggaaaagggaaaaaagtatctatgtggcctaaaaagttgrtaattagttggtcatcaggatcaaatatttatcactaattacagagtttagcaaagtcctagtggtagtgaagcaggagcctaggagagccacagtgaca

SEQ ID NO: 2181 - DNA, 201 bp, Homo sapiens
ttttctgtttaggagagaagaaaaaattgaatctgtctgtatagcacccactgagtttctcactgtattgatcaatctgtctgcatggatggaaacctaaycatgcattaaatttcaatcccatcaccctgcctttgacctaagaaatgtgctactaaggtagaagagagaaaagctacagaatcagatggtgtgtctctt

SEQ ID NO: 2182 - DNA, 201 bp, Homo sapiens
cagtgaccctcggcattctttcagagcacatgcagacttaaatttgcctcagctttcaggaattgagagatagcccacatggaaaaataagtgaaaaatgwaactaagtgagaggctttggcaattctgcgtgactattatttgagttatttcttatgggatatgcattatcttaaaaaaaaaaaaagtgtttcttagtag

SEQ ID NO: 2183 - DNA, 201 bp, Homo sapiens
atagttatgctttgatgtactcacacactaaaatgtcaaggatagttttctttaaatcaataagataataatttttgtcagtctatctgatcaccctcacrtaatcagaacttagcttagtctttacatagagaagatccctacataagaaaaacttaaagacaggccatccctctgcttgctttcaggggatgccttact

SEQ ID NO: 2184 - DNA, 201 bp, Homo sapiens
aaacctaaccatgcattaaatttcaatcccatcaccctgcctttgacctaagaaatgtgctactaaggtagaagagagaaaagctacagaatcagatggtrtgtctcttacaaatatactaaaaaagcagactttctaatttaggaaaagggaaaaaagtatctatgtggcctaaaaagttgataattagttggtcatcag

SEQ ID NO: 2185 - DNA, 201 bp, Homo sapiens
aatgagctgtgagaagtccacggcagggcttctgggaaaggcctacttggtcaaagagactcatgggaagtggtgcctcctcctcctacaggatgttgtcrcataggaaatgacgacaggaactgccccagagatcccagagccctgagggagcccaaaatgggccaggctgaccctgcgagttcagatggacagaaagac

SEQ ID NO: 2186 - DNA, 201 bp, Homo sapiens
acatgtggaaaggacaagtcaagacagaatgataaaattcttgaatgcttttgcttaaaattattcattctcttgtgtgtgtgtaaatggggacacacacrcacacatacacacactccatagacactctcgcatacttaaacggttccctaggtgcacttttatcattttatctcatctcactttggtagtttccattgt

SEQ ID NO: 2187 - DNA, 201 bp, Homo sapiens
ggaaactaatgggtttattgtgagtattaaatgagttaatacatgcaaaacaattcacacatagtaagcatgaaataaatactaattattatcattgttaygcactaagaaaggatttttgcaactaaagtgtcaaaagaaatggagatgctaaagaattatttggctttaaaagatgaattccagtacaaaatgaggctg

SEQ ID NO: 2188 - DNA, 201 bp, Homo sapiens
ttagacattgttttttatctgtagaaatttgattttggcctttaaaaaatatcttccatgtatctacttaactttttaagcatttgaaatgcagttatagyaaccgctaattctgtgttaatttggggtctattttgattgattgatttgatatcctcttatggtcctattttcctgctttttgtgtgctggttaattgtt

SEQ ID NO: 2189 - DNA, 201 bp, Homo sapiens
gagagcctcagttacgcgctctccacctcatcacacagcagccccgtgtaatagaaatcgcttattatgagggttggctaaataaaggcacattgtgaccrgtcacaatttctaaatgaatcctcctgactgatctggtcctgacactttcaaagctgccgttattactgaacctgaacatgtggaaaggacaagtcaaga

SEQ ID NO: 2190 - DNA, 201 bp, Homo sapiens
caagggtgaaccatgacgaatttgtgttccagcagccctgcttctttagaattgacagtctggcttcgtggttaattcacagcatctgaggaatacatccraagagggtgatactgtggcatgatggtaccaggattccaagttcattccaggtacagtcgatgcatcattcacagcagactcgtgagtgtccatcctgtg

SEQ ID NO: 2191 - DNA, 201 bp, Homo sapiens
aggccaagtgacctggtattgagcagtagataaacgttgcatctatttatcaccacccccaaaaaacctttttaaaatggcaaataccattcattaaatgwttatttttcctgcatgaggtcaaacaaataatctcaattttctgggtgttggggattcaaacaacacccaaaatgggatgttgtatactaagtcaaataa

SEQ ID NO: 2192 - DNA, 201 bp, Homo sapiens
ttgtgaaattctctccctcagataccctctgcctttgatggtgggcattaaaatgcttagactggaaaaaaaaaaagcaaatctttctgggtaattaagtraagtttatgttattcatttgaagatcaagctttgcttctccccttgaacacaggtgaaaataacaggaaaatgataataactttataagggccaaattac

SEQ ID NO: 2193 - DNA, 201 bp, Homo sapiens
atgttagtggcagcaagagacaagatgcccaaccacaagggaaccccaacactggagactttttctcatgtgttgggaagtctggcagcaggtggtccagrctgtgttgctcaacaatgtcagggctcttggtggctgctctgccatcctcttggtggcagggtggctgccgcagctcctggcatcatatcctcacacaat

SEQ ID NO: 2194 - DNA, 201 bp, Homo sapiens
tggtttttgagaaaagcattgtcgatttcagacctccaccttcagaaactggccagttattgccattttgtattgttttacaatattattgccatgagacyacattagagaactttgttttggctgctaaagtgcaatatgtggatataacaatctaataaagaagcagagaaagattcctttacactgcatgtgtattat

SEQ ID NO: 2195 - DNA, 201 bp, Homo sapiens
aacgtgtggttgggtcttcttttttaatctaatttgacaatctcttctttttaattggggcatttagaccatttatatttaatgtgatatgtgatgtgatwaggtttatatgctaattttgtgggagggttttgtcccatctcttctttttttttttctcttttcctgcctgattttagattaaatgaataatttttacaa

SEQ ID NO: 2196 - DNA, 201 bp, Homo sapiens
gaattaatatctctggggacactctgaagcaatgactgctggttatatgggtataaatactccagctccctcaccccttggctaaagtaattccaaggcaygtactttgcagttttccagagttaccctgtgagattcaactgccatcacccactgtggtagctgacttaataatgcatcctatattgtgtggccgccttc

SEQ ID NO: 2197 - DNA, 201 bp, Homo sapiens
tagtttcttagtatttcatatattttgatactgttgtaaatggtatcttttttcaaatatcattttctgattattcattttagcatagagaaatgcaactyatctttgtagaacgatcttgtattctacaccttgatcaactcacttattacagcatttttgtacacttcattggattttctagttgacaatcatgtcata

SEQ ID NO: 2198 - DNA, 201 bp, Homo sapiens
taatatagacgttcatggccatatgtaaagtgcagccatgttactcaaggatccatttaatttgttctgggctctgatgtcaccatgcacccactgaggtktttttaaaacacattgagatcatacatatagttaaaaacaatcaagtaataccaatagggttattaaatgattccctattaaatttatttcctaccccat

SEQ ID NO: 2199 - DNA, 201 bp, Homo sapiens
ataaattcagtcgaattgaagcttatattgggaagaaaacagccggctactagctgtaatatagacgttcatggccatatgtaaagtgcagccatgttacwcaaggatccatttaatttgttctgggctctgatgtcaccatgcacccactgaggtgtttttaaaacacattgagatcatacatatagttaaaaacaatca

SEQ ID NO: 2200 - DNA, 201 bp, Homo sapiens; identical to SEQ ID NO: 2163

SEQ ID NO: 2201 - DNA, 201 bp, Homo sapiens; identical to SEQ ID NO: 2165

SEQ ID NO: 2202 - DNA, 201 bp, Homo sapiens
tgctgattctttggagggtgctcttatggctgtgggctctgtggctgcactggaggtctctagttcctggcctttcacagtctgcacctgtgtcctccackcatgttgtagaacaaagctggtccctagggacattggaaagtgagggaggttggtcttcagtgtcttcctccctttgtgatgctttttctctactctctt

SEQ ID NO: 2203 - DNA, 201 bp, Homo sapiens
ctgtggctgcactggaggtctctagttcctggcctttcacagtctgcacctgtgtcctccactcatgttgtagaacaaagctggtccctagggacattggraagtgagggaggttggtcttcagtgtcttcctccctttgtgatgctttttctctactctcttcagatgattttatttattccttcacaaacatatattca

SEQ ID NO: 2204 - DNA, 201 bp, Homo sapiens
gccctcctctggaaaacctccctgtccccgtgggttggggcctcttgcctgtgcctcctccatgttctgaagctctgcttatgtcactgggattgcttgtyttaggtgcctctttctcctattagaactggagacatcggagggcaggaatggccgtgcatctctagctctggttatagtgcctgtcatatagcactgttc

SEQ ID NO: 2205 - DNA, 201 bp, Homo sapiens
atcagattggagggcatatagggccaatgcgggtggcatggctgcatctcacatccttgggcccttcattcagttagtcaacaagtgtttgaattgaagtragaacccatttgtttacaatgttacgctggacctacaacccttctttgttagagtctttatctctttagctattcattctggattccaaaaagaattatg

SEQ ID NO: 2206 - DNA, 201 bp, Homo sapiens
ctctattccaagagggctcagggacacccccgaggagagaggaagcattggtttccaacatctacacctccagcaaagaagtagtgtgagctggggtgaaygcaactgcagaatcttttgttgaatgaaacacctttcacgtgaagaaaaagcagcaagacgaaatgacactttgctaatgatgtattttatggactgcca

SEQ ID NO: 2207 - DNA, 201 bp, Homo sapiens
gtgggaggaagtttaagcacaaggcagggcaaatcctggcacggggcaggtgtgactgctggacagccatcctggtgtagctggtaagattttgcacaagsatgtcccatgtgtctgtactgccagccacacctctctggcctctgcaggaggtggctgatagactgatttgccatggaagctttccctggggccattacc

SEQ ID NO: 2208 - DNA, 201 bp, Homo sapiens
tattcatctaattttctaattccttattttccagctgaaattcacccaaaaggctttctctgtgtatcaaaatagtttgctttcattccgtccttggggtytggagaaagtggtggctgggatagagccctggggagatgggaggtggacatgtgtgaagggagccacatcaagaagttctccaattggggtgtccctggt

SEQ ID NO: 2209 - DNA, 201 bp, Homo sapiens
agaattatcccctggaggtgatttttaatttgggggttttgctgcaaaatggaaacctgactactaaggttgctttgcaacccaaatgcttctcctaccartcaattatcaaaatgagacttgctggatactgtagcaagtctttccgggctttctcctttaatgggtcaagtccaagttgcctcctttattgggaagagc

SEQ ID NO: 2210 - DNA, 201 bp, Homo sapiens
cctcaccaaatgtatgcagagttcttgaaagggctggattagacagtggttgccaaccctggctgcacaataccatcatctgctaagatttaaaaatgtcratacctgcccctgccccctgtgattctgacataattgtcctaggatgagacctgggccttggtactgttttcgtttttcctttttttcctggatagatag

SEQ ID NO: 2211 - DNA, 201 bp, Homo sapiens
cctattgtttctctggagaacactaatatgtcattccagtggggagttagctaggaaagtgatgagacctcttgtgtttcaaatcgtatagcttgccagtrtagaactgtgaacaaagtcatttttttctcaaatctgtaggccaaaagaatgatatctggagtttgatacaactttaagagatcatctagggcaacttta

SEQ ID NO: 2212 - DNA, 201 bp, Homo sapiens
cctaataatgttttcagtgatagtgtcttcatgtaaaccatgttagaaacttttcctggaggattaccttcagggccagtaatgaaccatgaataagtaaycatttcattaaaaacagtcatacctcctaagcacaatgtgtgctgggagatgtgggaagatgggtaggtcaggggttcaggaagggtcaggtagaggcag

SEQ ID NO: 2213 - DNA, 201 bp, Homo sapiens
aatggcatttgggaacttgtcttttgcctcctggttgacaaatgctgcttcttctgttatcttgacattttttaagcaaaacctctttctaaaataaacaractattcttttctggcatgaaattctccattctccagctttagatttttcactttctttttgctttgtcatataatgactttgctctttcttgaatcata

SEQ ID NO: 2214 - DNA, 201 bp, Homo sapiens
gaattatggtggaagaggaagcaaacacgtccttcttcacacaatggctggaaagagaagtgcctagcaaaagggggaaaagccccttataaaatcatcaratcctgtgagaactcattatcatgagaacagcatggaggtaaccccccacatgattcaattacctcccactgggtccctcctatgacacgggattatggg

SEQ ID NO: 2215 - DNA, 201 bp, Homo sapiens
ttaataaattactcaacctcaggtatttctttgtagcagtttgagaacagactaatacagcaacattgtactaaggaagagtccagctcagaagaaagttyctaagattttccttttccttttctcttctgtgcaatcagagaatgcactgaaaggtcactcctcagataagtagcacattacggaggtcagcgtggctgg

SEQ ID NO: 2216 - DNA, 201 bp, Homo sapiens
ttttggtggatacacacttgcatataagcaccatgttctctgccaatacacagaacatcaaaatacaaataaggttgttctttttttttccctgtaaattyggtgaagttggggctagatctgtctacttcatctggtattcccaggacctaatacatagtaggtccttaaaaagtatttgttgaatgaataaatgtatgg

SEQ ID NO: 2217 - DNA, 201 bp, Homo sapiens
cccccacttgagatgctggttacaagtattgggtgcccagggtattcccatttccgtccaacttgggtgtagagttcctgcaaccttctcctcagtttctrtaacttgctatataatagctcatagaacttatggaaacactttacttagtttaccagtttattataaaggatattataaaggacacaaatgcataaggaa

SEQ ID NO: 2218 - DNA, 201 bp, Homo sapiens
gctttgattttcgtttgtttcaggaaattgttgattttctttctaattttttttgactcaattcaggagcctgctgtttaatttccatgtatcttgtaccrtttccagagttcctctcattattgttttctaattttattccactgtggtctgagaagatacttaatatgattttgatttttaattatttgttcggatttg

SEQ ID NO: 2219 - DNA, 201 bp, Homo sapiens
tgtctctattaaaaaaaatactttaattgtatatatttttagatttacagagaacttggaaaggtagtacagagaggtctcgtatatcttgtgcctggatktccctattaacatcttacattatgatggttcatttgccacagctaagaaaccaacattgacacattaccattaattaaactccacagttttgattttgca

SEQ ID NO: 2220 - DNA, 201 bp, Homo sapiens
tcatgagatctggttgttttaaaagagtgtagcaccagcctgctctctcccttcctcctgctccaaccatgtgaggtgctgcttaccctttgccttctgcygtgattgagtttcttgaggactccccagaagctgagcagataccagcatcatgcttcctgtagagcctgtggaactgtgaaccaattaaacctttttttt

SEQ ID NO: 2221 - DNA, 201 bp, Homo sapiens
cctcccaaatctatccaagaagtgtgattgatagtgctgctgaggcttgagacaaagaagccctctctggttttcatattaatgctgggttatctcctacrgtattgattttttgtttggcttttgaaatttctcttctctgtttctgagccattcctataaaaatgaaagaggaggtgagggatgatgtcgtccaggttg

SEQ ID NO: 2222 - DNA, 201 bp, Homo sapiens
tagaatgtggaactttgagtgctacaaagaagaaagtcctgggcaaaccaggacacattgttcaacctgcttatctgtgggccacgctgcctacctggaaygccttcccttggcctggctcaccactcccgcacccttcgggtcacagcttagacaaatctgccttgattacccctctccctacagcctgcaccaggtatc

SEQ ID NO: 2223 - DNA, 201 bp, Homo sapiens
tacattgtgaactacctaaaccaagcaaatttacatatccatcatctcacatgcttatcatttttttatgggagaacatttgagatctactttcttggcarttttcaagaatataatacattgttattaactacagcagccatgctgtgtaatagatctccaaaacttatttaccctatttgaaatttcttactatttgac

SEQ ID NO: 2224 - DNA, 201 bp, Homo sapiens
gacttcttcaaccccaaagcgaggtcattttgccaagaaaaccaacaatcccatcagccagccaacaggggccctgggctgtggagggtgatgcaaaacamtggttttcaataaggggcaattaagcccctgcaggggacatttaggacacctgcctttgcaggggccaggccaggctggaggcctaattttttttttttt

SEQ ID NO: 2225 - DNA, 201 bp, Homo sapiens
tccctcatgggctggagcctgtgcctgggtggtattgtgagatactggcatggggcctggtacccaaggatcacttcctggaagacacagtgttgggaccrggcctttgaaagccttatgatgactgcacgtggaccagagactccagccttggggtcccttttttgacccagctccacagctcccctaggaggggaggct

SEQ ID NO: 2226 - DNA, 201 bp, Homo sapiens
gctctgtcctgaccaaggtgggagaaaagtcctgggagtttgcaagaggaacttgcactaaaaagaaaagagcatagggggacacaagccatcctcgtccycctgcattagaggagagatgggacggatttgctgtagtcaggacagtttcaagggcttgtgtggggcagaaagaacctgagcggaggccacgtttatgag

SEQ ID NO: 2227 - DNA, 201 bp, Homo sapiens
atttgggtggcacatttcctcctggctccatttctacaccagattcagatttgcctctgtatctttgcttatctggttcttccaggtgggatatctttccsttctctaataactgtagtagatttttaaaaatttgccttcttcccacacacccctgcgccctccatacacacttccttgcctgaatgatgttaggcttgt

SEQ ID NO: 2228 - DNA, 201 bp, Homo sapiens
gtttcttacctcattttgggggaaagataatgttattaatgccctttctagcaatttgaaaaaaaagacaaacatggcttagagtgaaatcctcggtgatygaaaatatcattagaaataagctcctggtgttcactctgtcatttccaagtgttctgatgagtttcatttgaatgctgcactatacggagttggctgaag

SEQ ID NO: 2229 - DNA, 201 bp, Homo sapiens
ctcacaggttaagggctaagtcccacaagaatgtcccccacttgagatgctggttacaagtattgggtgcccagggtattcccatttccgtccaacttggstgtagagttcctgcaaccttctcctcagtttctgtaacttgctatataatagctcatagaacttatggaaacactttacttagtttaccagtttattata

SEQ ID NO: 2230 - DNA, 201 bp, Homo sapiens
agtttccatccacctgcaagtgttcttcccctttcccatttcacgctcctgtccctaaataatgtttgctttttctattaataggactgtcttgattgtgrctggtccagctgacctttctccagtttcctattccagaatggtgctgcctgactctcttagcaccgtctactcttcagtcatttattccacatgtggtta

SEQ ID NO: 2231 - DNA, 201 bp, Homo sapiens
gctagcttactgccccgggccccacacagacaggagggggttggggtcgtgcccaggtacgaagttggtgggagctctgtcactgacagtgctttccttcycataggtgctcccattaagataacactgttcatgtcaaatctcttgcttcaatctgaaggttctgggtttctgtttggtgtctttggtcttcatcaatat

SEQ ID NO: 2232 - DNA, 201 bp, Homo sapiens
tttgcaaagataaaggcaggatagaaatgcgggccttttttaaacaaaaaaccaggaatccctgattccactttatgccagagaaaatggcagagaatggktgtgtaagtgtgagtgtgtgtgcgtgtgaataatcacttctccctaaggaataagaaactcttccaccaaattgatacacagtaagaaactctatacctg

SEQ ID NO: 2233 - DNA, 201 bp, Homo sapiens
tctgttcatagttcattgagagtttttatatgaagagatgttaaatttcatcaaatgctttttctgcatctattgagatgatcatatgatttttgtccttygttctgttgatgtgatatattatgtttattgatttgtgtacgttgaataatccttgcattcctgggataaatcccacttgatcatgttctattatctttt

SEQ ID NO: 2234 - DNA, 201 bp, Homo sapiens
ccctagctccctacctgctggtctatgagttttaacacatgcatgcattcctgtaactgccactagaatcaggacacagaacggtgctatcaccccccagktttcccatgctgcccctttctggttacactgtttccctgccgctaagccttgtcaatcactgatctgttctctatgcctatagttttgccttttccggaa

SEQ ID NO: 2235 - DNA, 201 bp, Homo sapiens
aactaaagtgtaagctcaataagaacaaggctttggttagttttgctcattgctatttccctggcatctagggcacagcttggcacacaatagatgatccrtaactatttgtgtgcaaatcaatttgtaaaatgggggaccacctgccccataaatttcttgtgatgtttaaattagacaaggtgggtatgctttgtatat

SEQ ID NO: 2236 - DNA, 201 bp, Homo sapiens
tcatcaaaaaccacgtaacatgcctctcctagttgccagcactgtgtaggccttgaggagccacagtgaatgagatatttcccaccttcaatgtcttcaaygagacatttctggatcatgtagaaggagagacagatgataggatcattagggatcatggcctctgcttcaccttgacctttttaccctcaatccatgtgc

SEQ ID NO: 2237 - DNA, 201 bp, Homo sapiens
tatcctggaaaaattgtccaaatgaggccacttttgagagcaaaaggagtacaattaatgcctacactaggataatagtaggcataaactagactgtcctrggcaaagtggatcatatggtcaccctacacactttctttacagctggtggtggctgttgcaaaatccagactacaaatgaactgagttttctgttgacct

SEQ ID NO: 2238 - DNA, 201 bp, Homo sapiens
ttctggagttgtggtatcaggggagtatcttttctttattcttgttgctcgtactaacattttaaggcatggagaaagtctgtagcaaggaaaccagtttkccagttaattgttgtttaatccaatctttccaaaatgtacttggccatggcatgtctttgtcatggagcatccattaacacctgaaagcccagggcgtgg

SEQ ID NO: 2239 - DNA, 201 bp, Homo sapiens
ttttcagccaccagaagcatgagccaaataaaacatttttctttataaattactcattctcaggtgttctgttatagtaacacaaaatggactaatcaaasccttcacaatgtgactttgcagcacctcccatctcgtggcagagtctctttctccaccccttgtacctgggtcagcctgtgacttgctttgtgcaatcga

SEQ ID NO: 2240 - DNA, 201 bp, Homo sapiens
taattccatctaccttactcttcaaggaataacagactccttcctttaattcatgccatcattctttctttgttttcatccattcattcatttcattcatwaaatttaggcattcatttggttcctgccaggcactggggatacaagagggggtgggactgaccctgaggtcaaggggtgtctcatcatctgtgggaagca

SEQ ID NO: 2241 - DNA, 201 bp, Homo sapiens
ttcaataggttttgaagcccccagatctatatatttataaaatgcactataaaaatctcctgagcagccaggatgttaactaagctcctgctatgcttagyaaaatatgctcaatataaaagctctaacaaaggacaaaataatagtttttattttatcattcaaaaaaattgacatagtttctatccttatagaaatttt

SEQ ID NO: 2242 - DNA, 201 bp, Homo sapiens
ttcaataactatgtattaaagagccaactatatgccaggctcggttcaagtcactggagaaagtattgacactcagaagattaggaagatctaggcacagytgctggccctgaaaagattttcttatgtgataagcattttgcaacatatcttagattcatgttgtaacaagataatatataaataaataagcagtttcat

SEQ ID NO: 2243 - DNA, 201 bp, Homo sapiens
tgcctcatcaacacctcccctctccactctatgcataacaactatggcccctttcgtacctccccctattatctcctgtatctccttcatcaacttcattkcacttttccctatctgatgttatattacatatttcttctgttgtttgcttactatctctctcctcattctagaatacaaaatgcacaaaggcagagattt

SEQ ID NO: 2244 - DNA, 201 bp, Homo sapiens
agtacagagaaagggatcctatcgcattggagaagtgtgggctgcaccagttagattgtcagaaatgatgaggcaagccctatatggaagagatcattaaygaataaaaattctaacatttctttactatgaagtttatgaaatgttttaagatgtattgtgcattggagcttcacggctatactttgaagcagatatttt

SEQ ID NO: 2245 - DNA, 201 bp, Homo sapiens
attatagtgcaattttgtggagggtgaaatggggattacacaatatagcgatttcctgttaacacctacatttttgctgatcaagcaaggtctgttggtgygagagcttaacctttattttatttccaaatgtgttttttattccgagtcccgttggtgtctatggtttcacttttctccatgagccacatgttaaagcct

SEQ ID NO: 2246 - DNA, 201 bp, Homo sapiens
tcagcagctataatctcaaataatttgtattgttaggttttcaatgtattgactattctgtccccttaccccagggaaagtatagacttgaggtcagggartaacaatggcatatgacatgtaagtatggtgacataatgtcatatgatatactacataatatatgtattatagtgttacatgcattatgtattacattat

SEQ ID NO: 2247 - DNA, 201 bp, Homo sapiens
ttttgatgaaatgagagtcttagccttgaatgcagccgaagaccaacagctcaattgctagtgatgtgtttcaaatgtagaaaggctggaaagaacctttrctgaacacctaaccctcaccttcatctatagatattctggcctggagaggtaagaatttacatatccaagggaaaatgggtgatttacgaccagaaagta

SEQ ID NO: 2248 - DNA, 201 bp, Homo sapiens
attatgactttgcaaatgttacattttctagttttaatcaacccctcatagagaggtaaaataataaatattgccatactcgtaggaagaaaaataacagwctggctggcttaattcagccagcttcctctactataattcaataaattttcaaaataaatattgaaattgaattagttcaggaggatgttttgttgtatg

SEQ ID NO: 2249 - DNA, 201 bp, Homo sapiens
aggatgacttcatggccctggaattttgaaaagccaggattctcagtacactgtggccagccttagagtctttgggtgtgaaaaccactctcagttacccrgactgatttttggttcctgttgcagtgctgcagaatctattaaaatccggcagctgaattgtcctggctctgccacaaagctcagctgccgggtccacta

SEQ ID NO: 2250 - DNA, 201 bp, Homo sapiens
gcagacttttaaaaaattaatctgtcagactttcttttccgtttaagggtagggaccatgtctttcatctaagtgccttcctcactcatcatagttcttgscagtagcaggctctcagtaagcattcattggatgtacaaatgtccctggttcatgataacccttattgttatttcttctgatggatactaacctgtaatt

SEQ ID NO: 2251 - DNA, 201 bp, Homo sapiens
attcagttatctccacctggtcccacccttgacatgtggaaattacaattcaaggtgagatttgggtggggacacagagccaaaccatatcagttgccttrtgattgttcccaggtccacagtgatcttatcacttccctattcagaaactgtcctggatcccacttttttttttttttttttttttttttgagatggagt

SEQ ID NO: 2252 - DNA, 201 bp, Homo sapiens
gcagttgagaagagtagaatgggtttgtttttgcaatcccagtggggtaattaaacttgcagtgcctgtcactcattccttaggctgagggacttttgagrttgcaatagctcatcttgtgttgcagctttgtttttaaatttagctaagttaaagcctatggaaaaaaaatcaagggaatggaagagatgagttttgaac

SEQ ID NO: 2253 - DNA, 201 bp, Homo sapiens
tcaagcataagatttaaatccctgacaaacaacttctaagattttagaaaaagttttgagtaccttgtgattccaactcttatctctgcttttgagcctckatttctaccccctcgtcatagtccttacccacctgtaactttaagacatcaaagttcattttaaaaaagaaaaaaataataagtttcatagaaagaaaac

SEQ ID NO: 2254 - DNA, 201 bp, Homo sapiens
aaggcagctctgtggctgttctgtgagcctttctcaggttatatttgtccccgaagttaacgatttataccaggggtccagtgggcttcatggatgactgygttgcaccactttcagatttgagaccgcatctgcattaagtacagacatatcagtaagttttggcagacctaaaaagtaaagcaaatttttttattgtaa

SEQ ID NO: 2255 - DNA, 201 bp, Homo sapiens
aaaaaactcatccatgagctggccaggtcctctcaaggagcaaatcaactgaggatgacattaaaaaaaatttttttaacttgtttcaacagttgttttcygcatttccacagtaattaccatgcttaccagtaagatacaattcatctctggatcatattttatgtgttttaggcaatagcagtgatagctaacaattac

SEQ ID NO: 2256 - DNA, 201 bp, Homo sapiens
agatctttgtgctgagagagattcagcaaagggaggccagagtaaactaggagtgggctccgggttagagttgaagcaagaacctgtatgaaaagaaaggyaatgtccacctcatatttcctagcagacataaaagacatggtgtctctcttgctcagtctttttcatcatcttactgggttcagaacatgggtaaagttc

SEQ ID NO: 2257 - DNA, 201 bp, Homo sapiens
tttataaatcctgagaagcaggtaggtctcatagtccttggatgattttaaatatttctcacagccaaacttttgattaaagctgagccacagacagttcmcattggtgttttttaagaactgatattttcttaaggactcgactttacagagtaaacaaacaggattggccttacaaggtaaaaactgaagctcctgaat

SEQ ID NO: 2258 - DNA, 201 bp, Homo sapiens
aataatgggagaatgatggacaatggagttggcctttggggctagatctaactgaattatacttggatgaatccatgtcacatgtatttgtatggctgttyctaagtcagtagcccaattcagcagttttttagtatcttctgttagccagacactgtggtaggcactagagattaaaaagtatatagtcattttccctga

SEQ ID NO: 2259 - DNA, 201 bp, Homo sapiens
acattcattctcttagattttactgagtaaaatcagctttttactatgaaaatgtagctggctgcacaaaataccatcattttccttttaatagattctgyattgtctacatagttttttaatgctgttttatctaaaattttaaaaatatacacacaatacacaccccaatacagttaacattaagacaaaagtttagca

SEQ ID NO: 2260 - DNA, 201 bp, Homo sapiens
cataagtatcagtcatttccctaaatttaactcaatggaaatggttcctcagtcaaattcaaaatctaaaggaaaaattgaaaggccaaaaaataaaatartctaaggtgtgaactgattataaacccacaaaagaatcaaagaaactgaatgagacacagcacaaatgagtgtccattttcaacaacacaggtaaatgta

SEQ ID NO: 2261 - DNA, 201 bp, Homo sapiens
atatacttgaattatcacattctagtatgaattattacttatatcactttccaatactgctagaaccttatagcaccttactcctatttaatccttttttyactttttgcattatttttgtcatgcattttgattatatatcaatttaagactccaaaagacattatgattattgttctatacaatcaatatccgtttgta

SEQ ID NO: 2262 - DNA, 201 bp, Homo sapiens
gtttcttgaaagtctttaagaaataacaatgtctcactacctgccactgaaatcacagattcaactgaaacattaggagaccatatacacaaacactttaygatttcaaaaagacaagctcattgggaagaaaaaagttctctgtctttgatttcttttagaatgataaaatgaaagggacattaatacatattttaagcc

SEQ ID NO: 2263 - DNA, 201 bp, Homo sapiens
tcaccttagcgtccctatagtaaatagagagtaaggcacacaagtctgattccaatcagagtgaggggtagtttttcggtttttttaatacaatgtgcatkctctcagattagtttctagctcagcaccaataataaaaaagagaaatactccaacccaagctacatgtgcaaagatgttcactgaagcattgtttatcat

SEQ ID NO: 2264 - DNA, 201 bp, Homo sapiens
tcttcaatctgatagggagcatatacaaaaaacctaacaccatacctaatggtgaatgaccaaaagctttcctcgtatgactgagaaataagcaagaatayccagtctcaccacttctattcaatattgttctggaagtcttaacaggcacaataagataagataaagaaataaaagacttttaaattagaaaacaagaaa

SEQ ID NO: 2265 - DNA, 201 bp, Homo sapiens
tttaaaatcttattcaaaatattaaataatacagtttcagattgaaaaaaattactgcaataaaacaattcagagatatttccattgtgcttcccttcctygttaggaaagtacactgtccaccctagagacaggatggacggccttcttccagctctaccgaaagcacaagcccactggctcacctgggccctgcttaac

SEQ ID NO: 2266 - DNA, 201 bp, Homo sapiens
cacaaatgaaatatagtaaataatttccagttgccataaaaaacaaaaacaaaagaaaacaagcgtggaggaaaaaaggtcattgtacacaaatatacttyatgtatacaaacaacttcattcaggtataattttaatttgaaagacctagatacagtattatttaagtgataatggcccataagatttattcaaattcac

SEQ ID NO: 2267 - DNA, 201 bp, Homo sapiens
tttcgaatactcactatgcgccacaaatcccctaccttgtcctactccttcttagcaaatgattttgactctaattcatagagaaaatagaattaaacaaktataccatttctaccacctgaccatccaattcacaaactcatttacatttgtgctcattcgtacctagtccctggtaatcttaagcgttgcaattagcaa

SEQ ID NO: 2268 - DNA, 201 bp, Homo sapiens
cagggcaaaaaatataattattggtaatcttcaaagaagacattgcctcattaacattctgatctaggcaatggtattctactgttttggaacaaaggccwtcacgccattttctgctttgaactagaagaaaaatcttcctttttttgtgatatgtaatgtagacaatagcaatgcaaaaagcaaaaataataagatgaa

SEQ ID NO: 2269 - DNA, 201 bp, Homo sapiens
taatcttcaaagaagacattgcctcattaacattctgatctaggcaatggtattctactgttttggaacaaaggccatcacgccattttctgctttgaacyagaagaaaaatcttcctttttttgtgatatgtaatgtagacaatagcaatgcaaaaagcaaaaataataagatgaaaaaagaaatggctatcttcctctt

SEQ ID NO: 2270 - DNA, 201 bp, Homo sapiens
cctgccacatttttttgtaagagaaaaatgttatagaaagacagttatactcatttggttaagtattgcctttagcagccaggcgtggtggctcatgctgytctccctcaatctaccagggtgctcaaagatatcagacttaaaacaaaacaattctcttggttcttcgacactctcatgaccctgctctatcttttattt

SEQ ID NO: 2271 - DNA, 201 bp, Homo sapiens
agagaaaaatgttatagaaagacagttatactcatttggttaagtattgcctttagcagccaggcgtggtggctcatgctgttctccctcaatctaccagkgtgctcaaagatatcagacttaaaacaaaacaattctcttggttcttcgacactctcatgaccctgctctatcttttattttcccttctcatccaagctt

SEQ ID NO: 2272 - DNA, 201 bp, Homo sapiens
gacttaaaacaaaacaattctcttggttcttcgacactctcatgaccctgctctatcttttattttcccttctcatccaagcttctttttgtatatatacwtatctttgccatttattttttaaaatcttattcaaaatattaaataatacagtttcagattgaaaaaaattactgcaataaaacaattcagagatatttc

SEQ ID NO: 2273 - DNA, 201 bp, Homo sapiens
ctggctcacctgggccctgcttaacatatattagggcttatgttttctgaaatgttgtagtgacacttgtaagtcaaccatggttcaaatcacatatttaygtattgatcagttctttattatagaaagatagacacaaatgaaatatagtaaataatttccagttgccataaaaaacaaaaacaaaagaaaacaagcgtg

SEQ ID NO: 2274 - DNA, 201 bp, Homo sapiens
ttctaactataactgccctggacattttgctattcacagataattgttgttttgttttaatcctttaaaagatggcttataatgaactatagaattttaaygggtactctcaaatacaggcttctgataactttagagattataatactggaataaaggaaaacgtacaggattcatgaagagctgaaatgttcatgaatg

SEQ ID NO: 2275 - DNA, 201 bp, Homo sapiens
caaactttttcagataactggttatttttcattttttccatgaggtcacaagggatttagttggggaaagagaagataagcccagaaagtatactaatagyaggattcctaaacagagcagggaagggacgctcctcattgcagagctccacgccccatggaaatgacagcttctgaagaagttgtagggtggtaaccacc

SEQ ID NO: 2276 - DNA, 201 bp, Homo sapiens
ggggatgtggttaaagaattcagctttggacatgttgaatttgacatcagagagtatggatataggagactgaagttcagaagagcaatctgagcaagatrtccatgtttgagacccatggtgtattcatggtattgaaggccatgggtttggataagatgaaccaatgcagtggttctcaaacccagctgtgcactagat

SEQ ID NO: 2277 - DNA, 201 bp, Homo sapiens
tttagaaattgaagtgtaattcctaagattaggaaagatacatcgtctaattggtctttgatatctgtccatgtgcatatgaggatgtattattttgtgtmtcaccttttatggtggccggccttcaagatggcccccagggattcttgcctcctggtactcatgctccaagtagtccatagtctcttcccacattgagta

SEQ ID NO: 2278 - DNA, 201 bp, Homo sapiens
ataagatatattgatggatcactagaagaacggctagagagatagatatgtaataaaatagatggtgaaatgttaatcattgaatcctatggtggctttakaagtatttaatgtgtaattttttcaaattttctaaatgtttcataacaaaatgatggggggaagcaaacaaattctcaagagggggaatctgattggccc

SEQ ID NO: 2279 - DNA, 201 bp, Homo sapiens
gaaacaccgctggtcccaaatattttatatagggaatactcaacctccacattcaaatactccatgtatattgctagtaaaacttccccaaattaccataygcatgatagtccagattatcattcagaaaatactcactcaactcttttctattgtgagaagacatactttcccaccctattcttgttggctgggcttagc

SEQ ID NO: 2280 - DNA, 201 bp, Homo sapiens
acaatgcatacaacagactcccagtgactgagtgggtagctatggggttggtaagtcagacttgagacctaggcatgtccaggatatatagaggatgggtrctcaagaagcatcttcttccttcactttagtgagtggaagcagagtttccacttttaacatgtgtctctcagagcgacagaaggataccaagagacaatg

SEQ ID NO: 2281 - DNA, 201 bp, Homo sapiens
ctaggacaagttctaagaggaaaaggatttgccaaggacatctaggcctctgcctagatgacctccagacgccagcttcaggctgcaaggccaggggaggrccagtgaaactgagaaatcaagggacttgtttcttgaattctcgatttcttgaatgagggccaagtgccagattttgtttttgtttccctggacctttct

SEQ ID NO: 2282 - DNA, 201 bp, Homo sapiens
agaagaaagaacctgcctagcatgatgaggtgggcttagcagcatagcacagggagtggggaagagaactggttccactacagcagggagcgactgaatgmagcctcctacaagcacatattttttccaagaaaacaaaagcttgtctataagcattaacaaatctttaattttagaggcccaagcaacactgctctggag

SEQ ID NO: 2283 - DNA, 201 bp, Homo sapiens
agtaagcaatatttatatatttaaatactatatgagatggcaaacccaaatgcatgcgaccacaggatgcatcctccttcatcccatcacacagccttctwcctagtgtctttgcacatctattctttattcaaatctcacctggaatgacaatgatgtgcagggaagagagggaaagacactcacacatttgaaagcctt

SEQ ID NO: 2284 - DNA, 201 bp, Homo sapiens
gtttttaaatttgtccatctcataaaaaagtaagctatgtcagaagcgttttgtccagaagatagaagatgtcataaatggataaaacttctctgactaawtattctaatcaaatactggcttctgctataaaataaaatactactcattccaacaaaacctgtctttattttttttttcagggaaagggagaaaagaaaa

SEQ ID NO: 2285 - DNA, 201 bp, Homo sapiens
ttggtaaggtatattttatatgtgcaagggacctgaatatttatgaacaagagatcagactggaacagcttggattattgctcagcagagaatcactaccytctccgagacttcatcaaggcttaatatgtgccaggacattaggacttgacatctgctcttcatccaccaccataagaacaagccccagatagcccaatc

SEQ ID NO: 2286 - DNA, 201 bp, Homo sapiens
taaacggatatagtatataatgctgggatttggtcttctattgatcccatcacccaaagagtgaccataataccaaataagttacgtttcaattgtttttycctcctgtcatcctcctcccttttggagtccccagaatctattgtttacatctttatgtctgtatgtacccatcgtttagctcctacttacaagtgagaa

SEQ ID NO: 2287 - DNA, 201 bp, Homo sapiens
cagcaccacagccctgtgtccctgctttctattgttcatcatgctgttctcccacaccccaaaagaatgagttcctgagctgataaagctcattcttccaytttgagaagcatggagggtcattggatgagggttcatggagactagaattggttagtgggtgcagagtcacaaggggaagacaagaaaggattaggcaaa

SEQ ID NO: 2288 - DNA, 201 bp, Homo sapiens
ttcccaaggatgcacaactcaggggcacaattgaactgaatcctggattgctgtactgcagcactaaccagcaagttcactgccctttgtaaaccacccartgaaagagctttaaaggatgggtaccagctaactttgagaaggactaaaaatgtgcatggtcttttcaggaacctctaagctttcctcactgctggaggg

SEQ ID NO: 2289 - DNA, 201 bp, Homo sapiens
tcttctctgaaggctagaaggaaaagaggtgatgtagatagcgccacacggcatgaatattgtaaatgacaagggggtgaagctcagatctgcatgttgcmatgcctatgcagacctgccactggggcccctgatgtgaatgatcccttcaaaggtgccttcttctttgccacctgtcccccagtactgtgacatccagtg

SEQ ID NO: 2290 - DNA, 201 bp, Homo sapiens
tgggggtgagaagccattagagagggagagagtgaagacgtggagaagggatatgtctgactcagtgaggtctcccactacctgggaaggtctttgcagascaactggatactgtgagcttccataacaagggacacccaaggctgtatgtgttgacttcctgggaatcaatgcagagggattatgttctactcaagggac

SEQ ID NO: 2291 - DNA, 201 bp, Homo sapiens
ctaagttaaaaaaaactggcaccaattttcatttttacatactgtgtataagagttctgattgaagtcacatccttgccaaacctgaagtagtcaaacttytaaatttttgccaatctattgaatatgaaatatttccttatggtttcaattagcatttacccactaatgaggttgaatgttttgttttatggttttcttc

SEQ ID NO: 2292 - DNA, 201 bp, Homo sapiens
aatctttggaggttgtgtgtttccaggaatttattcatttcctgtagattctctagtttacatgcgtagagacattcatagtagtctctgcgggtctttcrtatttctgtgagattagttgtgatgctgcctttgtcattcttgattgtgattatttggatcttcttttattttcctagctggtggtctatcaatcttgct

SEQ ID NO: 2293 - DNA, 201 bp, Homo sapiens
tgtctatgttcatcaggaatattggcctgtagttttccttttttgttgtgtccttgccagattttggtatcaggatgatgctgctttcaaagaatgagttrgagaggaatgcccccctcctctcttagaatagtttcattaggattggtagtagttgttctttgtatgtctggtagaattcagctgtgaagctatttggtc

SEQ ID NO: 2294 - DNA, 201 bp, Homo sapiens
gttttcagaaaaacctcagcccaaaataaagattccttatgactccccctccccagcaaaaggtttcagtggcatagtcagccccatctctaccagagttraagtgccgtggatcaggtcaaggtcagctgcctcctgccaggaagaaagacaattaggatgaggagtgagtgttataccaaagggggttcatgatttggg

SEQ ID NO: 2295 - DNA, 201 bp, Homo sapiens
atcctttttctaatctcgggaaaattcgaaatagcatcccggtgacacagcgaatgagagaacatcacccctattgcagctgtcacttgtatctgcaatckggtgaattatagagattagccacgtccaagaattactgcactttttgcatggttctgtgcatggcccttcttaaggtggaattgctcaggtttgtactca

SEQ ID NO: 2296 - DNA, 201 bp, Homo sapiens
gcttcattcatctggtttttatctgtttcattggaagcagttttaatctcatttcagcggcgctgatgataagcctgttagtttgcacaaattggttttgktgacaatgtgtagatagcaataatgtgtgatttccaaatggaaaagagaaatctatacaagtccaaaaaggcaggtgaagacagcaaaggagctgcgaaa

SEQ ID NO: 2297 - DNA, 201 bp, Homo sapiens
tattgttacatatttacccatctttctcacctaggctctacaccttctgtagaactaactcatgttattcatcttttttcctctccatagcttactacatrgccttgtatgtttattgtatgaataaacaatctggttcatccacttattaggtgtgtgttctgggcaatttaattcacttctctgagcctcagttttctc

SEQ ID NO: 2298 - DNA, 201 bp, Homo sapiens
cacttacaatgcaactatgaaatatgagcaaatgatactgagctcatagtggggagcaaggaatgagaagaaacattggttgagagggggttaagttcaargacttttgcaaagcttccagaggagtgtgactgagtctggtagttgagcacctgggacattatttatgatgcattgaaggatgtcaacagcattcttccg

SEQ ID NO: 2299 - DNA, 201 bp, Homo sapiens
gcagagctgaaaatggcatgctggtgcaaccgtagtgggttggctacctgcttatgcagtttatttctcctttagttcttcttgagctcaatcttggctayaccacttgcttcttataataattgctgctacacccacccaacttataatgattgctgctaggtccacccaactttatgacttgggaggtctggttgattc

SEQ ID NO: 2300 - DNA, 201 bp, Homo sapiens
gcgccagccaccgcgcctggccaagcctcctgaaaacactatttggagggaactgtgtgacagacttggcaataagacctggaggccccccggtacaccaygctgaagaatttggtttttactctgcaggctggagtttatgattttttgcctgcatccccaagaaaggcacatgctctgataattcctgctgtattctgt

SEQ ID NO: 2301 - DNA, 201 bp, Homo sapiens
ttgtaaacaaagcatttcacgtataagaaacaggcccattgtgcatttttttccattttatccacattttcccataaaatctatttgtatgcccacttttsagactgtttcattgcatgatatttaagcaatggtcaatcctatttgtgctacatttatggggatccttgaatttccaaaagtaaagaggagaatctgctg

SEQ ID NO: 2302 - DNA, 201 bp, Homo sapiens
atataataaaaattgtttttgtaaatcagcataggtctttactattctggtgcaggttttccttctcatattctcaactcctgcttacccttagagataasgaagactactttgacactgaattcttttttcattggttttatatattaaatttgtctcttcaaatagattataagcagcttgaagctcagaatcatttcc

SEQ ID NO: 2303 - DNA, 201 bp, Homo sapiens
cacctttcccacacattttcagactccagggccatagtctcctctagttaatgttgcaatgttttatattcaaaactcagctgccaccaccgaattatctstaattggcttagattgaggtggtccatggatgtcattgtaatccctgactggacttgtgggtgtcccttctctctgtcttctgccctggcctatgaagta

SEQ ID NO: 2304 - DNA, 201 bp, Homo sapiens
cacatagcaatgcctattcccaccacctgtgggtcctagtaaatctggttccctgaaacagggctaatcctggcaatgtccttacaagtcaccattttccyatattgaccacaacactgaatctttcttgaatgaatctattttcccacctggcctgatagcccctcactaaacctgaaaactgtgcaaagcctaacctgg

SEQ ID NO: 2305 - DNA, 201 bp, Homo sapiens
aatcaattccctagccaaggactatgaaatcagtagctcctggcctcaagcttccactattccaggccagttttgctctccatcaccataccctcatcagytgactttcaggatggcctccacctgcactggcagactccaaattccaaatgccccggaggtaacaacagaaacactttccccaatgtctgtacacacaga

SEQ ID NO: 2306 - DNA, 201 bp, Homo sapiens
ttaagtatgttgctgttttcctttgtctattcactgttttctgctcctccaccacccacagacatcaggttgcttgtgtttccaggaagtggacccttgtsgagtggtagaaagctaacagttctgttctctgtagaccgatgaagcacttcctggtgaaacatttctgctgttggaatgaagttcccagtttatcctaga

SEQ ID NO: 2307 - DNA, 201 bp, Homo sapiens
taggtgtatattaacctgacaattcaaatttataggctagataaatggagaatatttgctcatttcataaaagtagtttgcccagggcttattaaatctcwcattcttaaaaacattttatcaatgtagaataggacttttcaacaatacacattttgtaaagtggaaaatgcaatctaaactggatttttaaaaagaaaa

SEQ ID NO: 2308 - DNA, 201 bp, Homo sapiens
cagtttcttctcaggtagatgggtggagctctttttgcgtccttacaactctcagaaaagaaaattctcaagccaccctaatcattaggctttgcttatgmatgaaaaaaaatgagatgataaataaatgaattatctaactgacaaaagccttttagccatttcagatattcatttagaattacctgatatgagacttca

SEQ ID NO: 2309 - DNA, 201 bp, Homo sapiens
ctcggtctctcttagagtttcacacttgttctccagctatcttttatggtccaaggtcaagggccaattttcaggacaatgttccatgtcatgacccatcmaccaccaccaccaccaccaccttctcctgaaatcagagtagttcaggtagtcctagttaattgatttgatgaatatctttgcattgccaaaatgtaatca

SEQ ID NO: 2310 - DNA, 201 bp, Homo sapiens
atgcaaagtttaacaaactctacatgcaatatattctctttttttctaaaagaactcacttatttaggagcacagtttcttctcaggtagatgggtggagytctttttgcgtccttacaactctcagaaaagaaaattctcaagccaccctaatcattaggctttgcttatgaatgaaaaaaaatgagatgataaataaat

SEQ ID NO: 2311 - DNA, 201 bp, Homo sapiens
ggtgggggtggggtgggggggttggggggggagcagaattctcctgttacactggagagctgccacattttgtgcctgtctacatcacagtaattcacaawgtgctaaacattgcactttgccatatggtacattcttatttttcaattctcattacctcacatgtataaacaaacaaacaaacaaaaaaggcttcaggaa

SEQ ID NO: 2312 - DNA, 201 bp, Homo sapiens
gagacagagctctcttaggagttgtattcgaatgtaaactttaaaaaggtgaaagtgtgtgtcttgtgaatatgtggtgatagaatgttaggatcagaagkaccatcgtgtgtgaaagccatgttgaaaagaggagagggccaatacaactttagggctgataatatagggacatcacctagaagatgacatgagagccac

SEQ ID NO: 2313 - DNA, 201 bp, Homo sapiens
tacaactaatcctaaaggataagtttattattcaggcagaacctgatattaggaggaagctacagaaacaggctatgggaccagatagtactttagaggtrggtgaatcacaaggtcaggagtttgagaccagcctgaccaacatgctgaaactccgtctctactaaaaacacaaaaatttcccgggcatggtggtgtgtg

SEQ ID NO: 2314 - DNA, 201 bp, Homo sapiens
agagggatttggcagatggtgaaacccacaagagaagtacaaagtaaagagagagaaaatcagaatcatgaagtatcaaaagccaggaaaatctgataatytgtaaataatgtaggctggctccagttgtacaattgtagaaagtttggggaacaggtcacaaaatgacttcttacaatacctaaagaccctggattctat

SEQ ID NO: 2315 - DNA, 201 bp, Homo sapiens
tgtgatgttatagtgattcattgtctttctttctttcttaaaccattacattacaatttccccttggtgtaaataacagcccttttctctcttcatcattsttttatctcaaagaaagagtatgacaggtatgttaaaaactattgtctatgtgtctcttattgtataccaagctgtttgaagtagttaacgtaataaatt

SEQ ID NO: 2316 - DNA, 201 bp, Homo sapiens
gataccttttaaccaaactttttccaagcctgctcatggacaattcagcacacactcccccccattctaagcccatagaaacctggactcagccacaaagwtagcttacccacttacaggtcccctcagatgctgagagcttagtttctgtcgctcaatacaattctactctgccttactcactctctgatttccacgtac

SEQ ID NO: 2317 - DNA, 201 bp, Homo sapiens
aggacaggtctcaaccttcaagccaggatagtttgaagcctgaaaactgagatgccagttctggatagagtccatgaccagagtgagaatttctgtccccrgtttacccactctccctcaatttgttccttctcgatgataccttttaaccaaactttttccaagcctgctcatggacaattcagcacacactccccccca

SEQ ID NO: 2318 - DNA, 201 bp, Homo sapiens
tgatctagccctcctagtggtcatctcaggagaggctgcaaacggcaatctcaagggacaagggaagcaaattccagagctgcctccagcaggcgagtccrgtttctctggtcctgttcctcctgatccatcctgtcctccctatccatgttctttcttaacttgtcccatcctagaaatcctcattttaagtgggtccca

SEQ ID NO: 2319 - DNA, 201 bp, Homo sapiens
cagggtccccactgaaacccgatcttgaaggcaaggacaatttaaagcctgaaaaccaggctgccagttctgaagaatccacgaccagagtgagaacttckatcctcatcttacccactctctctagatttgcttataattcagcttggccgaattataaactgcaggacagagaagcttggcctccagaggaaagtattt

SEQ ID NO: 2320 - DNA, 201 bp, Homo sapiens
gaattatattctcaaatccttgataatagaatactgttgtataactattcttcattaccatgacatgaaatcgattttaaattgataaatgcttacttttmttttttggaaggcatcttttagtttggaatttagatgtgaaaactactaccaattgaatactgatgctagcaacaggagacaggcaaattcctaggcaga

SEQ ID NO: 2321 - DNA, 201 bp, Homo sapiens
cacttttgaatacttgcagaaggaaatccagattttgattaaattttctattgattgctatgcaattctgtatgaatcatggttccttaataattccactrtaagtttcagattgaataagatggttgtcgatagacttggacttcaacactgtagctttatataagtcatttgaaccttcagattcttaaaaatgccata

SEQ ID NO: 2322 - DNA, 201 bp, Homo sapiens
cagatgctgagagcttagtttctgtcgctcaatacaattctactctgccttactcactctctgatttccacgtaccctattcctcttggttgtgggacaaraacctagaatttgctgaactgcaggagtgaaaggggtgtattgtttctgcttgctgatctgcaggtggcaggagtaaaagagctgtaacactctctccca

SEQ ID NO: 2323 - DNA, 201 bp, Homo sapiens
ttaaaactcaaagaaaaaaagagctttaaaatacatgaggcaaaaacctgattgaactaaaaggagaaatagacaaatccacaattatagctgaagatttyaaccctcctttctcagtaattgatagaagtagtccgaaaaataatagagaaatagaagactctagcacattgatattattaagacatgcccaaaaaaaca

SEQ ID NO: 2324 - DNA, 201 bp, Homo sapiens
taaagaaggccaaatggagagccagggcttttgctatgatcccgctataagacaaagccatccgttacacctccaccatacctcatctcagaaggaggccragataggaccattagcaaggcacctgtagccagggatgtatcaatggagaactagagggaatctggcattcccactcccacacagcttcaataaggttcc

SEQ ID NO: 2325 - DNA, 201 bp, Homo sapiens
gaggccaagataggaccattagcaaggcacctgtagccagggatgtatcaatggagaactagagggaatctggcattcccactcccacacagcttcaatarggttcccctttgtgagtggcaacagaagaaaatggggaacctagacttctcttcccacctggtagtaataaggtgcgacccttcatttttcaatggagca

SEQ ID NO: 2326 - DNA, 201 bp, Homo sapiens
tctgcctgttcattttcctctcaaaagtctccctgactgatagtgacaaaacatcattggaggccaaacaggaatagacatggctttaataagctgagggrgaatgccatgattcacatccaaggtcttttttcagcttgcctctttctctaacaaggtccaggactcgagctgctcctctggaataacaaatgcacgtag

SEQ ID NO: 2327 - DNA, 201 bp, Homo sapiens
agtcgtcctgatgaatttacacagatggccagctgcaaggcagcctatctggtacctttaaacatctcttccaaggaagaaaaatcccccatgatgctcaycatttaagaaaaaaatagtatctctataaaactgctgtttaaataaggacctttcctgtgtctggtcactttgtggctgaaataaaacctagacaaaaat

SEQ ID NO: 2328 - DNA, 201 bp, Homo sapiens
gaatgccactagactacattactctccaggctgacatgcagaatttctaaaaagtattacattattgggataccatactgatgttccaatatagtaaccaygtgcttcctaccctgatataaactgtctaagaaggcatgagccttctgtatgtaaggacagatctctgagaagcctgaattaatgtttgatcagactcct

SEQ ID NO: 2329 - DNA, 201 bp, Homo sapiens
ccaggctgacatgcagaatttctaaaaagtattacattattgggataccatactgatgttccaatatagtaaccacgtgcttcctaccctgatataaactrtctaagaaggcatgagccttctgtatgtaaggacagatctctgagaagcctgaattaatgtttgatcagactcctgactcttcagcttgtcatacctctc

SEQ ID NO: 2330 - DNA, 201 bp, Homo sapiens
aatgcaaatttaaaaccactacaaacctattagcatgtctaaaatccaaaaatatgacaaaagcaagtgtaggtgagaatgtggagcaacagaacactcaygcattgcatatggaagtgcaaaatggtacagctactttgaaaacaatctggcaaaacaaaacataatcttaacatatagtccatcaattatgcttctgga

SEQ ID NO: 2331 - DNA, 201 bp, Homo sapiens
acaagtctgagaaactttcacagtgcaatggaccctaaggatacatgacaattaaaggtagcattgtatcctgaagaggatcctagaacagataaatgacsttaagagtaaagtagcaacattcaaatcaagtatgaagattagtcaactttttaaaaacaaaaaaggttttatgagtgaatataaaatcgacatccttgc

SEQ ID NO: 2332 - DNA, 201 bp, Homo sapiens
aaaggaggtttctggagcttttgaattgtttaattttatgggtaaggaatagactttagttttaggctttaattttggtgggaatttgttaatggttaccyatattgctctaatttgagccatttctgtggtgcaggtgctgtattggtgtaatgctatcatgcggcactcaccatacagttcttcagcgaggaggattgg

SEQ ID NO: 2333 - DNA, 201 bp, Homo sapiens
gtaatgctatcatgcggcactcaccatacagttcttcagcgaggaggattggtcaggggcctaaccacaaacccgaaatgaacaatagaatactcagtaartatttggccaagcttgcagtgtagtcttggaattaatttaaatgttggctctctgacatatttcacatccttccatctcattaattccagaagatataaa

SEQ ID NO: 2334 - DNA, 201 bp, Homo sapiens
cgggacacctgtcccatgacggtcttttgacctacttacagaggacagccctcacagagaaaggtagaaaaagtcagggagtgacctccaagttatcttayttcgggtagcatagcccgcaccctgtcagtgataataaataaaataaagaagaaaagcaggcaatttgaagggcaatagtctggtttaacaattattatt

SEQ ID NO: 2335 - DNA, 201 bp, Homo sapiens
agaagaaaggggttcattaattggtgagttcatcaatcttctctagatatataaagggaatttggccatcacttaagtgaaccatataggcaaggacaatycattcatgtgtcagacggataacgtccaggtgtatttttaatctttcaacaatgattgatgagtacaacaacaacaaaatattttacatatataaaatta

SEQ ID NO: 2336 - DNA, 201 bp, Homo sapiens
gaggaggtttacaaattgatttcatgttgtcattggcttttaggtttgagccaagagcattcactgtggggtgggagacgaagagggtaccattggaaaarccactatcttttggacctgcctacccatggcctctaaagaaagtagaggaatcccataagagaaagggacaatgaggggattacctaattctctgaccaa

SEQ ID NO: 2337 - DNA, 201 bp, Homo sapiens
catgctgaattaatgttttagataaaacaaagaagtcagctactgataaagatcccgtctcttccctgtgttcaaatggcaattctttaattactctattkctgtaaaatagaaaacttgtggtatggggtataggagagaggccagcatcataagggcaataagatgtggccaaacactctccacttaattgaaatttgt

SEQ ID NO: 2338 - DNA, 201 bp, Homo sapiens
caatatgactggtcttgttattagaagagaagagatacacagaaggaagatggccacatgaagacacaaggaggatgccatgtgatgatggagatagaaaytggagtgatggatctacaagccaaggacccgaaggattgccagctgtcatcagaaactagaagacagccctggaatagattctctctcagaactctccaa

SEQ ID NO: 2339 - DNA, 201 bp, Homo sapiens
agacttacatgcatttttttttttttaaacagggtcttcctctgggagatcacagctcattgaagccctgattgcactggctcaagtgatccttccacctyggttataataataaccaatcctctcagaaatgtgagaatggttcctgctttagcctcccaagtagctgggactacaggtgtgtgccaccatgcctggcta

SEQ ID NO: 2340 - DNA, 201 bp, Homo sapiens
catgcactcaggcatggaaacccaataatatattctggtacctacatataacttacataataaaatgcaacattatatttaaaaaccagtcttctgtttcmaaaattgctgtgtgtatgttgaagaatcttgtttaccctgttaaagagtttgaattttgtcttgaaagtgctgaatacttattaaagggttttgtgatag

SEQ ID NO: 2341 - DNA, 201 bp, Homo sapiens
gatccgattcttccggtacaccaaggcaagaaaccttgggatacagaaagccctctgtccttgccataagacaagctgcctatggattgctaaactcaaarggcacatgaagacacatgcccactggggagctgtaaacatacacccctagatgctgctgtggggtcggaacccaggctccccaagacctgcctgtttgtc

SEQ ID NO: 2342 - DNA, 201 bp, Homo sapiens
acaagctgcctatggattgctaaactcaaagggcacatgaagacacatgcccactggggagctgtaaacatacacccctagatgctgctgtggggtcggarcccaggctccccaagacctgcctgtttgtctgcatactcccgctaggagttttgagcagcagggcaccgaagaagcgagccacacccccatcgcccgccc

SEQ ID NO: 2343 - DNA, 201 bp, Homo sapiens
aaaaaaataataatttttaatggaagataaaaaatacaggaagaaaggttaacaatggaagtaataagaataaaaaagcagaatccaatagaaataaagamaagaaacaataaggacttttttttcaagatatttttaaaattgaaaaactctgaaaaagataatcaagaaaaaaagagagaaaacaccaattataaatgc

SEQ ID NO: 2344 - DNA, 201 bp, Homo sapiens
taattaaggcttagaattttaaaagatattttataggcctaaagttcaaaagtaactctctgaaattaatataggaggaatgaaaaaatagagtatgaagrataaaggtcagaaatacaagcgacactcgaggcaggtggcggggactgtaaatgactggtaaatatttcactgaagttccagaagaataggagagaatag

SEQ ID NO: 2345 - DNA, 201 bp, Homo sapiens
tttgactttagacagtttgattatgatgtgtctatgcgtagttcaatgtggactttttctagttggagttctttgagattcttgaacctatatagcctctkctttcctcaaatctgggaagtttttggccattattttcttaaataagctgccctcctctttctctatgcttcttctgggatttttataatgtgcatatta

SEQ ID NO: 2346 - DNA, 201 bp, Homo sapiens
tattgtattcattgaaaactcctgtaatctttgagacaatggggctctctaaaaagaagaagagtggtaaaggatgaaatcagagtcctttgcattaagcwattaattaaaaataaacaaggacattgcccttctgggaagatagagtagacatacctttccctgttccttccactaaataacaaacaaaacaaacataaa

SEQ ID NO: 2347 - DNA, 201 bp, Homo sapiens
tgaggatcagagtcattgtattcctgactgttccattgtcactgacaacgcaatagtctaccttacattactgttttggtttcacttcagggagaactacrtttgagatttcttgatactttccacttccagaatgtttacattttttactcccaacaatcactggcatgctgaattaatgttttagataaaacaaagaag

SEQ ID NO: 2348 - DNA, 201 bp, Homo sapiens
acagaaaaagagtatacaattggcaagttttctacagtaaatgctgtaagtaaagggggatcaggagcctaaaggtagaagaagcctgtttaaaatgtgtmaagctgaggaaaacattgattccatgttggttagtagtcattaatctttaatatattcttggaactgtgttatttaataatctcattaaatatttagaac

SEQ ID NO: 2349 - DNA, 201 bp, Homo sapiens
ccacatcctaaaacatcataaaggtcataaaataaacttcaacaaatttaaaataattgaaattatgcagagtataatctctaatgacaacagagtcaaastagaaatcagcaacaacaacaaacaaaaactgtgcaaacacttggaaactaaacagcatactttttaataatccatgggttaatgcagaaatattaagag

SEQ ID NO: 2350 - DNA, 201 bp, Homo sapiens
tatatgaaaatgtcttttactgtaagatcaattttctcttattttacaatgggagatttcaatggaggagaaacccaaatgtcaaaatcctgagttttttyagctaggattttgactattccagtgcctctagaaacaaatttactaagtcatttttttcagattcaaaaaaaaggttttgtttctctcaccataatggta

SEQ ID NO: 2351 - DNA, 201 bp, Homo sapiens
aatgaatttttttctccctgtgtatcatgaggacagagtttgagtaaactcagttttaagactgaacgaatcatctaatcttcccatctcttcacttgccytttgattttacagatagtttcagagtcatacaatgaattgcccaacatcttgtgttgaatagtgatggccatttttcaaattcattcacttgtctcctta

SEQ ID NO: 2352 - DNA, 201 bp, Homo sapiens
aaagtgactgctctgttagtctgggttccaaaaagaggacattgataatacagatgagggctcccagcctacttttgatcaactacatcatgatctggaartaagcatttctaagtcactgagatttgggagattctctattaatagagcttaacctaccctctcatgactccagactagagtaagcacttcattttgagt

SEQ ID NO: 2353 - DNA, 201 bp, Homo sapiens
gatcagactcctgactcttcagcttgtcatacctctcagtcatacctctcagtctaattctgtctattctcacgttcatatgccttgtcattgatttgccyacagcatctagtctccagttctcttatcagtaaaaattatccaccctcagatctcccctagagagggagtagccttccagactcattcaaccacatcaac

SEQ ID NO: 2354 - DNA, 201 bp, Homo sapiens
aaattttcttctgaccaaaactagttttaagaaagtaaagagtcatgtcacacacatggagaaaatagtagcaatacataatcctacatggggtttatttycataatatatgaagaaacaatttcaatttaatgttaaaaagaacatcaacccaataaatcaaatactttacaaacaaacataggaatgactcttcataat

SEQ ID NO: 2355 - DNA, 201 bp, Homo sapiens
ctaaacagaaaacacggtgtatgtatctctcctgcaaggatgttcctctgtgaggtggacaaagtgctgttctcctcaagtatccttgagtactctctatrcaaattcatacagagaccacggaatccaaaaacaaataaaccagagcagtgagagctgatggtggcatactgaatgctgggaaacacagaccacatcatt

SEQ ID NO: 2356 - DNA, 201 bp, Homo sapiens
tatatctataatagtaacaatgtattgtatcgtattaaaagtatataaagtaacataggtaatggaaattaatgaaagcaatgccacaaaatatgagaagraggagttaagaatactttgttacaaagtacttgcacaacaggtaaagcagtatgttgttatttgaaggcagacccaaattaattaaaaatatacagtaaa

SEQ ID NO: 2357 - DNA, 201 bp, Homo sapiens
tgtactttaagaggtgaatagattaccataccatgataatccttactttgaaaactcttcagtgatggagagccatcaagccactcaatgacatggataartcttaaatgcatgtaaagtcaaagaaatcagtataaggtaacgtgctgtatgcttccatctatatgacattctgggaaagataaaactatggagatacaa

SEQ ID NO: 2358 - DNA, 201 bp, Homo sapiens
aatcagtataaggtaacgtgctgtatgcttccatctatatgacattctgggaaagataaaactatggagatacaaaacatagtggttgtcagaggtttagsgagagggaagggttgactggattaaacacaggagatttttttagggccatgaaatgaaccctggcattcttcaaggctttatgaagatcacagagaatta

SEQ ID NO: 2359 - DNA, 201 bp, Homo sapiens
ttaaatgatgttataaaaatgaggccctaatgcaataggactggtgttcttataggaagagaaagtgacaccagagattcactccaccctggtggtaccaygtccacacagaagaaagacaataaaaggaaacagcaaaaaggtggccattgagaagccaggaagaaaggctttactagaaaccagccctgatgggttgga

SEQ ID NO: 2360 - DNA, 201 bp, Homo sapiens
ccatcccctcagtggaggtggtggaaaaaaaaatgaggcgttgacctaagtaattttggaaataacttgaaatcataaaactaaggaaaatattaattgtrtataagtactgcactctaattggtaatattgtttctaataggcacaggggttaacaattccaaaactgctgcccatcaatcctggcactgaacaaataag

SEQ ID NO: 2361 - DNA, 201 bp, Homo sapiens
caatcctggcactgaacaaataagtagatggatgaagaatggtgagaaccaggcttctcactgttggagtgggagattatagataggctaggggagaaagrtacaatgaaacacactataatcagagtgtatatctacatctatgtatctgtgaatctatttatctgtctgtctgtgtatacactggctaaggtacttaca

SEQ ID NO: 2362 - DNA, 201 bp, Homo sapiens
ataagtagatggatgaagaatggtgagaaccaggcttctcactgttggagtgggagattatagataggctaggggagaaaggtacaatgaaacacactatwatcagagtgtatatctacatctatgtatctgtgaatctatttatctgtctgtctgtgtatacactggctaaggtacttacatatgttacctatgtctgtt

SEQ ID NO: 2363 - DNA, 201 bp, Homo sapiens
tcagagtgtatatctacatctatgtatctgtgaatctatttatctgtctgtctgtgtatacactggctaaggtacttacatatgttacctatgtctgttcrctgagagggtgtggaagcaattataccactgtaaggggtaagtaaaagcacattcagcacctgaaccatggtttataataccattctttaaaacaaggaa

SEQ ID NO: 2364 - DNA, 201 bp, Homo sapiens
taggatgaagtcaatactcattgacctttccaaaactcctagggaccttaaaaactatgcacatgtgtttatagcattatttactgaatatgttaagaccmgtgttaagacctgctgctcagaaaaaaatattcctttcaaagtagtactgctcactaacaatgaacctagtcaccctagagctctgatggagatgaacaa

SEQ ID NO: 2365 - DNA, 201 bp, Homo sapiens
aattaaaaaaaacttgaacagatttttgcatcacaaaaaagtcactgtttaacggaatgccatgtttaaagtgctgaaaagtcaaaaatatatacaaaccytatgaaaatgtccttcgagaaaggtaaagcaaagacctttttggacaacaaaaagctgaaagaattcatcacaagcatgtctgtattacaagaaatgtta

SEQ ID NO: 2366 - DNA, 201 bp, Homo sapiens
gcagattatagggctgaggcaaaaactgtacattagaaatctgaaacatcttgtagtgctagaaagtaaggaagtactcaaaaatgaaacgatgacattawgtcaaagggacataggatccaattggaagatcttccattggacaaggtggacagatttgagcagcaagataaataaaatagttttggattataacctgca

SEQ ID NO: 2367 - DNA, 201 bp, Homo sapiens
caactctcagtggcctgaaataataatgtatgttgtattcatttcgcagtgccatgagaagtagaggggagttgggagctttgctccatgtgtcattcatmgggacaaggatcctttcatccagtagtcctaccatccctgagtcatccatgtaaccagctacatttggctagtagatgagaaatgaaaacgagaacatca

SEQ ID NO: 2368 - DNA, 201 bp, Homo sapiens
atttctcttgagaaattttatcttcctaccaagtgcttcatgtatctgtacacacacacacacatacacacacacatatatacaaacacacactatttatytgcttcatatttccagagaactaaagtatgtttactcagggaaaaacaaaatgataaaggggaacatgcaactggatagtaatttctgaagcagtctttc

SEQ ID NO: 2369 - DNA, 201 bp, Homo sapiens
tggaaaagggttgcagatgtaattagttaagatgagttcacactggagttggataggcagttcttaatcaatatgactggtcttgttattagaagagaagrgatacacagaaggaagatggccacatgaagacacaaggaggatgccatgtgatgatggagatagaaattggagtgatggatctacaagccaaggacccga

SEQ ID NO: 2370 - DNA, 201 bp, Homo sapiens
attttctaaattaggctttattttgtaaggtgctattaggttcacaacaaaattgagtggaaagtataggcagtttccacatgcccccagcctacatacamagacagccttcccataatcaacacactgctgcacctccccccaacaccaccctgccccagcaaagagtggtacatttgttacaattgatgaaccttcatt

SEQ ID NO: 2371 - DNA, 201 bp, Homo sapiens
tgtgtatatgtgtgtatgtatgtgtgtgtatatatatgtagagagagagagagtgagagagatttgtaatcatttctcttctctctcatatgctaccaccrtgctgataagcccacaggaaaaacaatggagaattatgggtgaaagagtggaagagctgaaagacacagactgtccttgaggagaagtacaaaggcacgc

SEQ ID NO: 2372 - DNA, 201 bp, Homo sapiens
gcaaactacccatctgacaaaggattaataacagaatatataaagagctccaacaacactatagggaaaaaaaatctcacaatctgttccaaaaatgggcraatatttgaacagaattttctcaaagacatacaaatggcaaacatgcatattaaaagatgctcaacatcattgattatcaaagaaatgcaaattaaatct

SEQ ID NO: 2373 - DNA, 201 bp, Homo sapiens
aactttttaaagaaaacatacataaaaatctgtgtgatactgagtttggttatgagttcttagctaccttaccaaaaggtcaattcataaaagaagaaatragttgaacattattaaaattaaatatttctgtgaaatatattgttaagagaattaacagactgggagaaaaacatctgcaaatcatatacttgataaaga

SEQ ID NO: 2374 - DNA, 201 bp, Homo sapiens
taaaagaagaaatgagttgaacattattaaaattaaatatttctgtgaaatatattgttaagagaattaacagactgggagaaaaacatctgcaaatcatmtacttgataaagaactatcatccaaaatatatatagaacatttaagacccaataacaacaacaacaaaaaatcaaaaatgggcaaaaatctgtacataca

SEQ ID NO: 2375 - DNA, 201 bp, Homo sapiens
taatcaacattttgctttctaagaatatgactactttgtatgcctcatattagtggaattattcagtatatttctttgtggattggcttatgttacttagmataatcttctcaaggtttgcctatgttttagcatatgacagaatttcctttattttaaaggctgaacaatattccattgtatgcatagaccacattttgt

SEQ ID NO: 2376 - DNA, 201 bp, Homo sapiens
agttggtgcttgaccaatttggtattcatagggggaaaaatcaatcttgaagaaaatcttacatattacaccaaattaattcaaaatgtattacaaacttkaatggaaaatgtaaaactatctacattttaggaaaaacacagcataggagaaaatccttgggatctaggaggaggcaaaaattcagttttgatactgaaa

SEQ ID NO: 2377 - DNA, 201 bp, Homo sapiens
actgagataatacaaaactgcttcaatgagcaattacaaatacataattgaaataattttaaaagagagagtctcagcaaagaaatagaagctataaagargaaacaaatgaaaattttataagtaaaaatggataaaattaaaagaaaaaatttaaaaaattataattagaaatgaagactattattacctttctcaaaa

SEQ ID NO: 2378 - DNA, 201 bp, Homo sapiens
ttcatgcatgtttttctgatttcatccagtttattatgtcttttagttcactgaatatctttataagagttattttagattctttttcagacagctcacarattgcatttatttagtcttaatttctggagttttgggtttctttgatttgaccatgttttctagttttttaatatgccttgtaacttttgccagaacttg

SEQ ID NO: 2379 - DNA, 201 bp, Homo sapiens
agacacatctctgataacagccataagacttacatgcatttttttttttttaaacagggtcttcctctgggagatcacagctcattgaagccctgattgcmctggctcaagtgatccttccacctcggttataataataaccaatcctctcagaaatgtgagaatggttcctgctttagcctcccaagtagctgggactac

SEQ ID NO: 2380 - DNA, 201 bp, Homo sapiens
tattgttccttgtagaaccaccttgaggaaggaagggtttgacaagcctgaaaaacatcctctctgctgtattcttaaagatgttagaccctctgagaggygaggctggctgggcttctgggtcaggtggggacttggagaacttttctgtctagctaaaggattctaaacacaccaatcagcactctgtgtctagctaaa

SEQ ID NO: 2381 - DNA, 201 bp, Homo sapiens
cctaaaaacaaatttaaaaaaaaaaacatttcactagaaaaggaaaccacggatgagtattattccttgacattgatgcaaaaatcctttacaaaactgartccagcagtgtattacacaggataatacaccatgaccaagtgtttttcattctaggaatgtaagtttgatcccacctttataaataagtcaacgcaattc

SEQ ID NO: 2382 - DNA, 201 bp, Homo sapiens
catgaccaagtgtttttcattctaggaatgtaagtttgatcccacctttataaataagtcaacgcaattcatcatattaacagattaaattataaaaaacrtattatcccattaataaatgaagaaaaagcatccaaccatgttcaacatacattcataattttttaaaactctgaaataaactaaaaatacaaatccttg

SEQ ID NO: 2383 - DNA, 201 bp, Homo sapiens
aataatctgtctttatttacagatgacatgcctttctttgtagataatcccaaagaaaattcctagaactaataagtgacttatgcaaagtcacaacatamaaagtcagtatacaaaaaagaatgcttttctatatagcagcaatgaacagctagatataaatgctataaatataaaatgcaatattttataaattttata

SEQ ID NO: 2384 - DNA, 201 bp, Homo sapiens
atgtatagtatatttccaactattatataaattaaagcaaaatgattacatgaaaagcatctaagcgataaattattgattgtaatggatggcacactaaygttaaagaagtatgaattaactttattaaaaaataataagtgtcagtaattctgaattctgtttaaaacttatttgtttccaagttctattatggtgttt

SEQ ID NO: 2385 - DNA, 201 bp, Homo sapiens
agtatagattgtatagtcactgacatacaagttgaagccattggggtagaaggaactgctcaggaatagtgagtagtgagaagaggaaagaatagaaaagrgtgttttggtcaggaacaagaaatgcttgaattagtcaggttagccatgatgagctgtattgtcaactatagcaactgccattggtttcggaaaattaga

SEQ ID NO: 2386 - DNA, 201 bp, Homo sapiens
atctcattaaatatttagaacaattttgtaaaaaaaagatatttatctccattttacagaaaaataaaatcttgtaagggtaaagtcacttgcacaaggtygtccaactggtaaagagcagtttatgactttttttgagacagggtcttgctctctcattcaggctggagtgcagtggtacattcatagctcgctgcaacc

SEQ ID NO: 2387 - DNA, 201 bp, Homo sapiens
ctggcattcccactcccacacagcttcaataaggttcccctttgtgagtggcaacagaagaaaatggggaacctagacttctcttcccacctggtagtaayaaggtgcgacccttcatttttcaatggagcagttttacaggtagttgcctaaaacaggtttaaataaaacccagagtcttctaacatgagatcccaattt

SEQ ID NO: 2388 - DNA, 201 bp, Homo sapiens
actatgtctaattaaaaattatattggtagctaaaaactcctcaaaaaatactgaggtcggatgatttcaataatgaattatattgtacatctgagaaagwtataaagccaattgtacacaatatcttccaaaaaattgaagaggagaaaacatattctaactcattttatgagggcaacattaccctaaaaacaaattta

SEQ ID NO: 2389 - DNA, 201 bp, Homo sapiens
tggagaacagttcagagatttcccataaaactaaaaatagagatagtatatgatccagcaagcccactgttgggtatatatcccaaagaaaggcaataagwgtatcaaagagagagcctcactcctatgtttgttgcagcattgtttacaatagctaagatttggaagcaacctaagatttcatcaacagattaattgata

SEQ ID NO: 2390 - DNA, 201 bp, Homo sapiens
ccactaaatctgatttttctcggtcctctttgtggtctaggaggacaggccagggggcaggttttcaataacgcatcaggaagggccactaaatcctacaytcctctgtcctccttgtggtctaggaggaaaactagtgtttctgctgctgcattggtgagcacaactattccaatcagcagggtccagggaccattgcag

SEQ ID NO: 2391 - DNA, 201 bp, Homo sapiens
gcaggtttttgagaatgcatcagtaaaggccactaaatctgatttttctcggtcctctttgtggtctaggaggacaggccagggggcaggttttcaataaygcatcaggaagggccactaaatcctacattcctctgtcctccttgtggtctaggaggaaaactagtgtttctgctgctgcattggtgagcacaactattc

SEQ ID NO: 2392 - DNA, 201 bp, Homo sapiens
accctctagcactttctcctttcatgaagtgggagaaaaacacttgtgtgattaaataaacctgaagtccagaaacatgttaagtaattttctttataacygcataatcagtaggcccagagttcaatgtaggtctatatcttcttataggcagtcattgaggaaaaacaggaaaagtcataatgccttgagtactgataa

SEQ ID NO: 2393 - DNA, 201 bp, Homo sapiens
gagtaccatcagacccctttctttcacttgctattctgccctatttttccttagaatttgggggctaaatactgggccagttaaaagcacctagcacagtygccagactaaagacacaggtgtcaggctttctgggaaagggctctctaacaaccccccaaatctttggagttgggagcattggtttgcctggaaccagct

SEQ ID NO: 2394 - DNA, 201 bp, Homo sapiens
aataatcatggtgactttcaaagtaacaaatgtactagacaaagttaaacaggtaagaaaggctttattcgagactactacaatagggagagagactaagktcaactaagtagaagcaaaaggtgagaaggttttgaggcacttggttgatccagtgaaaaagaagttatggtgaagattaatcaatgggatgttttgagc

SEQ ID NO: 2395 - DNA, 201 bp, Homo sapiens
agatgtccttaccacttttattcaacgatatactggaaaccccagcaatggcaatcagacaggaaaggaaaataatctgtctttatttacagatgacatgmctttctttgtagataatcccaaagaaaattcctagaactaataagtgacttatgcaaagtcacaacatacaaagtcagtatacaaaaaagaatgcttttc

SEQ ID NO: 2396 - DNA, 201 bp, Homo sapiens
taaaaacattctttacagaaatagaaaaaaaattctaaaatttatatgaaaccacaaaagatccagaatagctaaagctatcctaagcaaaaagaacaaarcaagaagaatcacattacctgacttcaaattatactaaagaagtatgataaccaaaacagcatgacactagcataaaaacagacacataaaccaatggaa

SEQ ID NO: 2397 - DNA, 201 bp, Homo sapiens
tcgaactatatgttttctataagaaacccactttaagtattaagactccaatagtttaaaattaaagaaatagagaaatatattatgctaatactaataayaaaaactcagtagctatatgaatttcagacacagcagactgcagaacatgtaaaacaaccagtgataatgagaaaatattacgcaatgataaaagagtcc

SEQ ID NO: 2398 - DNA, 201 bp, Homo sapiens
tatgacaaaagcaagtgtaggtgagaatgtggagcaacagaacactcatgcattgcatatggaagtgcaaaatggtacagctactttgaaaacaatctggmaaaacaaaacataatcttaacatatagtccatcaattatgcttctggatatttacctaactggtttgaaaactcacaaaaaactacatatgaatagttgt

SEQ ID NO: 2399 - DNA, 201 bp, Homo sapiens
aaatggtacagctactttgaaaacaatctggcaaaacaaaacataatcttaacatatagtccatcaattatgcttctggatatttacctaactggtttgaraactcacaaaaaactacatatgaatagttgtagccgttttttgcgtaattgtcaaaacttggaaacaaccaagatgtactttaagaggtgaatagattac

SEQ ID NO: 2400 - DNA, 201 bp, Homo sapiens
atcttaacatatagtccatcaattatgcttctggatatttacctaactggtttgaaaactcacaaaaaactacatatgaatagttgtagccgttttttgcrtaattgtcaaaacttggaaacaaccaagatgtactttaagaggtgaatagattaccataccatgataatccttactttgaaaactcttcagtgatggaga

SEQ ID NO: 2401 - DNA, 201 bp, Homo sapiens
atagagaacccagaaagaaacaaatccacagacctatagtaaactcgtttttgacaaaggtgccaagaatatacactggggaaaagacaatctcttgcatwactggtgctgggaaaactggataaccatatgcagaagaaagaaactgaactcctatctctggccatatacaaatatcaatcaaaatggattaaagactta

SEQ ID NO: 2402 - DNA, 201 bp, Homo sapiens
ttcatgtaaaatatatctataatagtaacaatgtattgtatcgtattaaaagtatataaagtaacataggtaatggaaattaatgaaagcaatgccacaawatatgagaaggaggagttaagaatactttgttacaaagtacttgcacaacaggtaaagcagtatgttgttatttgaaggcagacccaaattaattaaaaa

SEQ ID NO: 2403 - DNA, 201 bp, Homo sapiens
ggaactgtgatacaaatgtatgccatcccctcagtggaggtggtggaaaaaaaaatgaggcgttgacctaagtaattttggaaataacttgaaatcataaractaaggaaaatattaattgtgtataagtactgcactctaattggtaatattgtttctaataggcacaggggttaacaattccaaaactgctgcccatca

SEQ ID NO: 2404 - DNA, 201 bp, Homo sapiens
aaggtacttacatatgttacctatgtctgttcgctgagagggtgtggaagcaattataccactgtaaggggtaagtaaaagcacattcagcacctgaaccrtggtttataataccattctttaaaacaaggaatccactttgggaggccgaggtgggcagatcacgaggtcaagagatggagaacatcctggccaacatgg

SEQ ID NO: 2405 - DNA, 201 bp, Homo sapiens
aaaatttataaatatacattataaaattttataaataaaaatatatttataaatataatagcatttacagtagcatctcaaaataaagtacctaggtatarctctaaaaaaatatgcataggatctagctatatgcaaaagcaacaaaatacagttgaaagaaatcaaataaggtctaaataaatggagagataattacat

SEQ ID NO: 2406 - DNA, 201 bp, Homo sapiens
cagcatctatttaaaaaaatctacagaagtttacaacataaagagtgatacttgatgtatttaaacttttagtggaaatatcaaacatgaggtttgaggartttcaggatgtaatgtagatcatgtccccaaaaatggaactgtgatacaaatgtatgccatcccctcagtggaggtggtggaaaaaaaaatgaggcgttg

SEQ ID NO: 2407 - DNA, 201 bp, Homo sapiens
aataaggtctaaataaatggagagataattacatgtttatgggttagaataatcaatactattgagatgtcaattcttcacagcttgatatacagatttamtgcaatcacagtcaaaattccagcaaaccttttgtagatattgacaaactgattctaaaatttatatggagagacaaattacctagaattgcaaatacaa

SEQ ID NO: 2408 - DNA, 201 bp, Homo sapiens
aaattaagctactactctcctatagaggatggaggatagaagtgttattttcttcatgtttacatttcaaagagatggttcccagccctttgagacagacrttttctgggttgtaaactggaaagaggctatttacagccatttcaaaggaacagaaaaagagtatacaattggcaagttttctacagtaaatgctgtaag

SEQ ID NO: 2409 - DNA, 201 bp, Homo sapiens
tcatttatttgtgggatatataaaaatcaaaataaactcagggacataataatagaaaaatggataccagaggctgggaagggtaatgggggttgttgacrgggagacggggatggctcatgggtacaaaaataaataaataaataaaatagaaagaatgaataagacctactacttgatagcaaaatagggtgagtatag

SEQ ID NO: 2410 - DNA, 201 bp, Homo sapiens
tttcagacacagcagactgcagaacatgtaaaacaaccagtgataatgagaaaatattacgcaatgataaaagagtccattgtagaagatataacaatccwaaacctttatgcatgaacaacagagtatcaaattacaacagacaaaaatgacagaactggtttttaaaaacagacaaatccattactttagttagagaca

SEQ ID NO: 2411 - DNA, 201 bp, Homo sapiens
tgtccttgaggagaagtacaaaggcacgcccccaaagccaagaggagatgaaataaacaaacccatcattgggaatttaaaaatcctgtgctaaaagttamcaaaacaaaacataaacaaaaaaaaaattaaacacatgccaaatttctagtcaaattaacataaatccttacactaaaggtcttatacgtcaattcctat

SEQ ID NO: 2412 - DNA, 201 bp, Homo sapiens
agagagagagagagtgagagagatttgtaatcatttctcttctctctcatatgctaccaccatgctgataagcccacaggaaaaacaatggagaattatgkgtgaaagagtggaagagctgaaagacacagactgtccttgaggagaagtacaaaggcacgcccccaaagccaagaggagatgaaataaacaaacccatca

SEQ ID NO: 2413 - DNA, 201 bp, Homo sapiens
acacacacacacacacacacacacattattatatatgtatatacacacattatattgtatatatatatgtatatacacacattatattgtatatatataartcaatgcatacatacattatatacatgtgtatatgtgtgtatgtatgtgtgtgtatatatatgtagagagagagagagtgagagagatttgtaatcattt

SEQ ID NO: 2414 - DNA, 201 bp, Homo sapiens
tatgctaaccagtcagggataatacgagatgccacccggcattcacaggaaaagtcttctgaaatcagacaacacctttcaaactcttataccaaactctrgacttgggcaacatggcttctcccctttctaggtccagaaggttatagaacaccaggagtatagttcataaaaaatgtatacacacacacacacacacac

SEQ ID NO: 2415 - DNA, 201 bp, Homo sapiens
actcactgcgagggtgtgcagcttcattctcgaagtcagcaagaccaagaacccaccagaagaaaccaattccggacacatttttgcaaccacgaagggayaatcaccaagtggtgagtaccatcagacccctttctttcacttgctattctgccctatttttccttagaatttgggggctaaatactgggccagttaaaa

SEQ ID NO: 2416 - DNA, 201 bp, Homo sapiens
agagtcatgtggttgtttcttattattccccttgtggggaccagggatcactgagtccactactgccccactctagatgtgcccatttgggccattgttgycaccagccatcctgactgtggcctgggtgggtctctgccatgaacacattcatttagggctatgactctgctttcagctatgtctccaatttgccatttg

SEQ ID NO: 2417 - DNA, 201 bp, Homo sapiens
cctcctcacatttttctgtatcagtgccaaaaactcaaatggctccagggcctaggcaggcaatatgttgagtaaagtatggaagagagggaggtgggaaytgaaatgagctgaagatgctaaaaaattcatgattgctgtccaagtctggcaaccactcttcagttcagttgtcaccgtctttgaatatgggcacactct

SEQ ID NO: 2418 - DNA, 201 bp, Homo sapiens
ccttgcagagaaagatgtcaaaattctgtcaaggttctctaaactttgtctataaaaataattacaaacttttacacttcagaacactgacttccattcaytggaatttgttttctgggtggccatcctcaaatgttgcacttgaataatagattctgactcttttgattattttaagttgacaggatggagtaaacaatg

SEQ ID NO: 2419 - DNA, 201 bp, Homo sapiens
acagcttcaggcaaatccatctagtttacaaattcttttgtgtgagtggaatttttagggaaactgaaagtcactgagttctaccagctgagaacaaaaayagctttatgagacagaagacagaaagtaaggcagctggcctctgtgttgtaggaagagacacatcttagatgtcctatgaggctgacagtgtctgccaga

SEQ ID NO: 2420 - DNA, 201 bp, Homo sapiens
acttatatactaggtttgaccaaatttgaaaacatctgagcagtcactgtcaatttcctgcaaggaggctgactccgtgtggtcaaacagtcaaaagttaytgcctcctcctcacatttttctgtatcagtgccaaaaactcaaatggctccagggcctaggcaggcaatatgttgagtaaagtatggaagagagggaggt

SEQ ID NO: 2421 - DNA, 201 bp, Homo sapiens
ggtttgaccaaatttgaaaacatctgagcagtcactgtcaatttcctgcaaggaggctgactccgtgtggtcaaacagtcaaaagttactgcctcctcctyacatttttctgtatcagtgccaaaaactcaaatggctccagggcctaggcaggcaatatgttgagtaaagtatggaagagagggaggtgggaactgaaat

SEQ ID NO: 2422 - DNA, 201 bp, Homo sapiens
gaaggcactcatttttttcccctacggttttgaagttggtctatttttcatacagttaaagtggggttttcctttgacagaagccttagtaggattttctyaagtcagttttctctacgtcaaagttagaatctattattcccagagtctagcattggtgtatgtgactttatttagatgactgtattttcatgttttccc

SEQ ID NO: 2423 - DNA, 201 bp, Homo sapiens
atccacacccagagtaccttacactaaattctaggccctgagatgttccctcaagaaggcaacatttgagctacactaaagggagcggagtgtttggaaakgcagatttagcaacacagggaaaagcaaaagctgaaacaaacaccttgaagacagatgaatgcagaatgagttccactgttgccctcccgggaatcataa

SEQ ID NO: 2424 - DNA, 201 bp, Homo sapiens
ttgccactggatgctgtctaagcagaagcaggtagctattgggtcaggatgtcctaagaatactgagttgatcatccctctgagggccatttgcagtatgytatataataacctcacaggaccttacgcatcaatcgcacacactggggagtttgtctttagggacatttgttcaaatctctgcagtctgtctggaccaat

SEQ ID NO: 2425 - DNA, 201 bp, Homo sapiens
atagggatacttcctctccctttcaattattccaccctatctccctgaggcatctacgattggttctgatatttcatgtgaatttaccaagtaaattttgytaagttcaaccactaaataaagcttggattaaaggattggtagtaatatcaccttggactcaattcgagtgtactttaccttgctttatgtccaaagtat

SEQ ID NO: 2426 - DNA, 201 bp, Homo sapiens
ataaatcttttcatctatgctattttaagggtcttacagtttttgctcttagatgtttgataaattttgaattaatttttggatatagtgtaaggtaatgkttcagatttttccttttgcatgctttctcatcaccgtttgttgaaaagactgccctttctccattgaatggttctagcatccttgttgaaaattgtttga

SEQ ID NO: 2427 - DNA, 201 bp, Homo sapiens
ttgtatttctgacttagaattttttaggtgcattttaacaacatagctcagacagtaggcacaactttttagcctgctttttgtcacagacccttttcaayacaagcgtttgacttagtgtttaatatctcactaggggatggctacaagatttccatccaagtgtgggtttgaaggaggaattttattctttatgtattt

SEQ ID NO: 2428 - DNA, 201 bp, Homo sapiens
atccatctggccctcggccttttttttttttttggttgagggatttttttattattattactgattcaatctgactacttgttatcggcctgttatttgcyctctatttcttcctgattcgttcttgtgaggttgtgtgtttgtagatgtttatccatttcccctagttttccagtttgtgaagatagagatgctcgtaac

SEQ ID NO: 2429 - DNA, 201 bp, Homo sapiens
gggatcatctgtgtcaattaccaagcaaacactaagtgttcaatatatttttttataacttgcacttatgttaatcacattttatcctcatggtaattttktaagtttgtaattattatgactattttactggtaaggaaattggtgctctgagaggtcccatgactttcttgtggtcactgagcagcaggaagtggaggt

SEQ ID NO: 2430 - DNA, 201 bp, Homo sapiens
gttcccatttgttgcacccaatctgatgataaacgtggagaccccaggaacactggcctggaaaggccctgaaaactgagagatgtagctgaggcaagagraaagaaaggaaatggcattttccctccaaaaggcctaggccttcttgaatgagccatagccagggagccccagtgtgtgcctgggaggtgtccaccagca

SEQ ID NO: 2431 - DNA, 201 bp, Homo sapiens
ggattctcccccgcagtccacaggtctttggggttttggtgcataccatcccagtccactttctcaacgaagtggctcctgctctgtaggccttttcaacratcgtggtgatttttaatcgtatatttaagcaactcttttcaaagttattttgcctccgttagctcatttggccctcacaagaagcccaggagagactca

SEQ ID NO: 2432 - DNA, 201 bp, Homo sapiens
gtgcctgggggccagacagggtcacggaggtggaggtgggagagatggccctgggggactggggttcagtggtttctcacagtgttcaaatcaaagcccaraggcaaggacttgggcttctttcaaagaatgggagccttatttaatccataatcccaccatagctgatgatgcctgcagaccccactctcagctccacgt

SEQ ID NO: 2433 - DNA, 201 bp, Homo sapiens
gagctggagtctaaaagagaggattctgccattcaattccgcttatcaaatgtctggtattatgtcccccaagccagaccccagaccaggagcaccagagyggggacagagtgaagtgaccccagtccctgagcttcaggtggaggacaggcaagtatgtgactaattgtgagatgcaatgtgagaactgtgtcagtagtg

SEQ ID NO: 2434 - DNA, 201 bp, Homo sapiens
aggaattgaatatgatttcttttctctttttcttcctccctcccttcatctgttccttcctttcttcctttccttctttttttttgtttcttaacatttaratctcaataatatttatctggttatttattttaccttgttatttattcacccatatttcccacaaggttcatgacatgctcctgaatttatttatcttct

SEQ ID NO: 2435 - DNA, 201 bp, Homo sapiens
ggccaatggcacagggccaatccccagctgccaaaatgaaaagattttggaacttctgcttggtaaatccccttacagcagcagcacattgtcagccaagygttggcagtcgaatcagcagtgagaaataccttcaaacccacattttgtgagttcctccagggccaactagggtagaatttgtgaaaggacaggatggtg

SEQ ID NO: 2436 - DNA, 201 bp, Homo sapiens
gaaattctagctccagaatccaccattctgtgccccttttctgccatgattaccagtgtgaatgctcagcctcagtgtccttgtttgtgaagtggttatargataccaaccttagggctgtcctaatgagcactgagtgacagaatgagagcaatgcctctgactcactgactggccacagaatgagagcaatgcctctga

SEQ ID NO: 2437 - DNA, 201 bp, Homo sapiens
aaaccccttttaaaatgtaaatcaatgtcttttaaatactttttaaaattattttttctggaattatatttttgggattttaatctttcaggattttaatrttcagaattatggcatttgggattttgtctttcaagattatggctccaacccacctccctgaagccatcagatgccattgtctcttcaaagtccttccaa

SEQ ID NO: 2438 - DNA, 201 bp, Homo sapiens
aggtgaatcagacacagatcctgcccttgaggaggacagagacaaggaaacaaacaattaaaatgcagcaaggtaagggcaatgtgagaggcgaacgcagygcagtaagggagctgagaggagtggaatcagactctcctgcagtcagcaattatttcttggaagaggagacaaccaagctgagtcttaaaggttgcagga

SEQ ID NO: 2439 - DNA, 201 bp, Homo sapiens
ttcactgtcctcccattcctcttggtcttcaggtctcagctttattattactgcctctgggatggtcttcctgatgatccagactagacctgaccctgttygctcttcccaaagccctctgcatgtcctgatccttacacccaggaaacacactgaaatcacctggctcattggaacagagggagtgtcctgttgtctgta

SEQ ID NO: 2440 - DNA, 201 bp, Homo sapiens
ggagatagtaaataaagctgcaggaatttgtaggggaacctgtaggaccttgtgtgccaaggagttttaatgactcctgtagataataggagaagcccaayggaatggcttaaaatggacaatgtgatcagattgtgatttataatgactgctttgctggaagtgtgatgaatggattagataaggtgagtctagagctag

SEQ ID NO: 2441 - DNA, 201 bp, Homo sapiens
atgcatgtagccctgggcttaggctggggagtgtgctcaaaaatcgattctattagcaaatctgtcctagctattcctgcagcaccttcagaatccagacmagaccccttcacctccctcctgcttcctcttgttctctttctcctacatccagttctatatcccaaacatctatgtccttctagaatgacctctgcatcc

SEQ ID NO: 2442 - DNA, 201 bp, Homo sapiens
gatcactcactggcaggtgagttagtgctggtcattggagggggcctcagttactctccatagggcaccatggatgtttcacatcatggcagctggcttcytttggagcaagaggtctgagggtccaaggcagaagctgcaaggccttttatgacccagcctcatttcttctgtatcgtgttggtcactcagggctagctg

SEQ ID NO: 2443 - DNA, 201 bp, Homo sapiens
tgagttcagtgtggtaagtgctatatcgggcaagcacgaagtgttttgggagtgcagaggagggagagcctaattggctgacggaggaggggtggtggagyggttaagaaggtctcatttttggcttcctcaattattgtgatcatataacctttagtgaaactcagtttcctaatatgtaaaatgggcataatataattt

SEQ ID NO: 2444 - DNA, 201 bp, Homo sapiens
aaaaatgacaatgagcaaataaatcattacagttttgggtatatacaaaggatacatccctccttactgtataaaatgagaaaaataacaaccaattcctwtggtatacaaataatactggtcagtgataacataaatgataaacaaatgtaaagttaaaatatattgttattagtaagagcagtaaaacaatatatatat

SEQ ID NO: 2445 - DNA, 201 bp, Homo sapiens
tcgtgttggtcactcagggctagctgtgattcagtgtgggaggggattacgtgagggcaaggataccaggaggcacagatcataggaggctggctacttcygtctacctctgactcctgatgattcatagctttcccattgaacatacacttgtcccttcccaaggcccacaaaagtctcatcatattatagtatcagttt

SEQ ID NO: 2446 - DNA, 201 bp, Homo sapiens
tttaaagtgtaaagacaggctcccacacattagcaaaaagaggttctctctctttcatcttggggcaggaggaaaaggggacctgcttcctgagtctgtayctgctgagtattatggtggccactgtacacactgactatgcccttgcaatttagttagtctttcttaagtatcaaaagtcaccttttattcaagaatttg

SEQ ID NO: 2447 - DNA, 201 bp, Homo sapiens
ccatcacccctcctcagccccgtcccattgctgagacccagcatgacttgcagcctggtgctcacagctgtgacacctttggggcccccatacccccaaayactagggcacttgcccaaagccacaaagtcagcaagtagttaggtttggattcaaactgaagtctgtctccaaaaccacatcctttcaactattccctgt

SEQ ID NO: 2448 - DNA, 201 bp, Homo sapiens
gatttgacaaagttttttctgtaaagaataaatctttttggctttgtgggctacacagcctctcacaacgactcaactctgctgctgccactggcaacatrtaagtgaatggatatggctgtgctctaacaaggctttatttacaaacccaagtggtcagttggatttggcctctaggccatagtttgctcacccctgatc

SEQ ID NO: 2449 - DNA, 201 bp, Homo sapiens
tagatttattccctggaactttcagttttgaaagctgataaattccttttgcacttaagtcatttttgaattagaattcctgtctctggcaactgaaaaartctcaactgaaatgcctggacaagagacagagcactgcagtcacctttaccaatcattaggctggcattcccactttacaatgtgacttttgaacctggt

SEQ ID NO: 2450 - DNA, 201 bp, Homo sapiens
tatcccctttgacaggtacaagtcatgcctgcatgttgatgtaatttggaaagctgttttgaactgagtgtggtcagagcctgggaagcctgagccctctrtggaaacccatgtgtcacctttttcccaacaggcttccaaatggaatcttaaattctgcacggccatttatcagagtttccaaatgccactttccaattt

SEQ ID NO: 2451 - DNA, 201 bp, Homo sapiens
ggctcagggcaagggcgtgtgctctggcgtgagacaaatcttggttcttggctccaacactcactcccatttctgagtcttggtttcctcagctgtaaaaygggtttggatgatgatgcttttctcaaggttggtgcatatgtgcacaaggcccagggcatgaaggatggcataggggtttcttgcccgttcccttccttt

SEQ ID NO: 2452 - DNA, 201 bp, Homo sapiens; identical to SEQ ID NO: 2088

SEQ ID NO: 2453 - DNA, 201 bp, Homo sapiens; identical to SEQ ID NO: 2087

SEQ ID NO: 2454 - DNA, 201 bp, Homo sapiens; identical to SEQ ID NO: 1827

SEQ ID NO: 2455 - DNA, 201 bp, Homo sapiens; identical to SEQ ID NO: 1828

SEQ ID NO: 2456 - DNA, 201 bp, Homo sapiens
aacatgttacattagataatattctatagatattgtattttggaactagatgatatcctaataatcctctattctttatttcttgaaatatagataaaagrtcctaaagtcctaaatactgatgtgcaaatttctgcttttttttcaaggtcccccgccgacccatgatggctactcctccactcagccctcatcccatat

SEQ ID NO: 2457 - DNA, 201 bp, Homo sapiens
attcctgactgtgttttattcagttatcacacccatgttgaatccttttatatacacgttgagaaattcagagatgagaaatgctatagaaaaactcttgygataccaaagtaggaagacaggatttagatgctccaagctcaattaagaagtcatcccatcatggcatctgtttgaagttcaagatctcaacgtctatat

SEQ ID NO: 2458 - DNA, 201 bp, Homo sapiens
ccctaatagccagtttggcgcatacctgtggttgctctgtctaccttcctgttgtatcccagtagatccccaaaataagcatcagcagccacattgggacsctaccctccacaatgaggaagagattgagaggtttggagacaggacagggaggcaggcagggtcaaaccaaaggttcccttggagaatcatgagtgggtt

SEQ ID NO: 2459 - DNA, 201 bp, Homo sapiens
tcatccatccgtctacccacccactcactcctccctttccccactgacccatccacttgtccagtcaaccagtctctacaggcaggctcatttctagccaygaagtatacagagatgaatgaggaaatacagacacatgaacaagccaattaggatacactatatctacagcaatagagacatgagggagctgctgagaaa

SEQ ID NO: 2460 - DNA, 201 bp, Homo sapiens
aaattcaagactacttaggagaatatcttcatgccttttggatagaaaaagatttcttagctgggacacaaaagaactaattgtaagcttcatcatgatayattagacttcatcaaaattaaaaatgtatgttcattgagtagatggatggttaccagaggctgggaagggtagtggggggtgagaggggaggtaaggata

SEQ ID NO: 2461 - DNA, 201 bp, Homo sapiens
caaaaaatgggagaaattcctataggagctgagaatggatgggggacatcagcatatgaaagtcattagtaaatttctataagatagagactagatgatgrgatactagtggatgaggaagaatggaggcagtgccagctctaagcatgaactgaagagactgagacagagggatgattaaacttaatagtgatgcccaac

SEQ ID NO: 2462 - DNA, 201 bp, Homo sapiens
atttacattttatgaattattaatatagttggatttaaatctgtgaccatgctgtttatgtttgtctggataactattttccctctccatttttgagggayaattttgcttaatataaaattctcggttaacctatcttttttagtcttctttcagtactttaaatctgttgttttattatgtattggcttgtcccatttc

SEQ ID NO: 2463 - DNA, 201 bp, Homo sapiens
ttgaacatgcaaagtggaacccacaggcaatgatctcagtatatattttgactcatcatccaaagaaatcagagatgaaagcaacatctaatggctgagartacataaatagccatttccactcactttcaattaccctgcagaggaatctggtcacagatgagctcagtaaattcacaatatgttatcctcaatagctaa

SEQ ID NO: 2464 - DNA, 201 bp, Homo sapiens
tatcagcccttcaagcaggggaacagcaaggaatagatctgaggcagcaatcagcactgtggcaaactagaataaacacacagagcagaatttgaaaaackttcaaaaatttctatcagagtagatgattctctgtatggtgctatttcagaacatttcaaaatacatgtattagcataaggaaaggttaatggcttatgc

SEQ ID NO: 2465 - DNA, 201 bp, Homo sapiens
tcatcaagtaagtcaatgtttattacagtttaacagtgctgcttgtctcagcagtcttaaagtgattatatcagtgcctgttttggtcagggtatagccargaaaatgcaatttactttaagtatttacaacggaggatacataatacaggaagttggttccacagatgataaaggagccgagaagccaaatgaaacggtg

SEQ ID NO: 2466 - DNA, 201 bp, Homo sapiens
ctaaagtaaatgtgaactcattcagagtttaagccaattctctcatcaagtaagtcaatgtttattacagtttaacagtgctgcttgtctcagcagtcttraagtgattatatcagtgcctgttttggtcagggtatagccaggaaaatgcaatttactttaagtatttacaacggaggatacataatacaggaagttggt

SEQ ID NO: 2467 - DNA, 201 bp, Homo sapiens
tttttttaaaaaatctctgctgtgcattaataagtcaacattgcctagaacagtgcctgacacttaagtagaaagtcataaataattgctaaatggaaggraagaaggaaaaaaggaagaaaggaaggaaggaagggagggagggagggaaggagggaaggagggaaggagggagggagggaggggccaagaggcaatgaa

SEQ ID NO: 2468 - DNA, 201 bp, Homo sapiens
aaataaaaagtgctacacagttgttatctaccaagacaacaattgacttaaataaatgcaaatacaatttattggaagttccttattactcttttaaatayggtaaatccattctagaggttaatacctatccgtgtgtgtgtgtgtgtgtgtgtgtgtgtgtgtgtgtaaacttccaaaaaatttcagtgtgaaagtttt

SEQ ID NO: 2469 - DNA, 201 bp, Homo sapiens
gtattttctagtatttttcaaatgattaaatgaaaatgtgatgttgtagaccaggtaccatgagaacaaggtaaataggtaggatgctgtgttctggaaayctcaatttatatagctctggagagtgttttctgattgaggtttcctgtgtgttctctgattctccctagaacttcgatataggtcaattgaagacggtgg

SEQ ID NO: 2470 - DNA, 201 bp, Homo sapiens
agagtagaggttaaagatatacaggattttttttctgatgaatgataatgggtttcactggatatagtgaggggatttttggaagtagagagtggtgggakataggctttaaaaaaaaggtactataataacctatgataggattagaatgtggtcataaggcctgctttgggagataaagggtttttgttgtcttttggt

SEQ ID NO: 2471 - DNA, 201 bp, Homo sapiens
tatttcactctcagcttaaaatcctgaaaacattcagacatctgaatattgtataaattaaaccctacaacctccagacatctgaatattgtataaaaatkgccagtctagtagtttaagaagctgaaaggaaatgcttaatctatcagtctagctactcctctagtaagcacatctttgaacaagtacataggaaaggcc

SEQ ID NO: 2472 - DNA, 201 bp, Homo sapiens
gttaaataggcagcaaggtgtgtgaaaggtgaagggaaatacaggcatgttccagaacagagattattttatgttatactagggatggggacctatgggasagtcaacctacattttatttttaggaagttcttttttatattagtgtaaagaacaaattggttgaggcaagaactgtaacagaaatattagtttggagcc

SEQ ID NO: 2473 - DNA, 201 bp, Homo sapiens
gtggtattctttgtacacaaaatgaacttttaacacaaaatgtactaagataggtggggtatgtactaacgacagaatatagatcctctgggaaggagaaygcatatacaaagtgaatgcatacctacttacaggctattctttagagacttctccaagtgctcaagaaaagtattggccaccgtagtgagaaagcatgct

SEQ ID NO: 2474 - DNA, 201 bp, Homo sapiens
cagtaatttatgggtgcaaaataaactgaaattcctaatttgaaatgttggtgaggttagaaacgatctcagaagaagcatttaggctgaagaatacatgyttgtaaagagatatgaaagttatcggaatcttatcccaaattcactcttaattttgtgcttagggtggtttccacttaaaatcgttttatctctgaaact

SEQ ID NO: 2475 - DNA, 201 bp, Homo sapiens
gaccagcatagagatggacatcttgaaaagtgacaccctgcactgaaatccatccttgaacgcttcctggccaggcagcctgggaaggccatgtgaggacwccctcttcctgcagaagctccctctgtcctccttccttgctcctcccttgttggttaggctttggtaattctcccttctccagctgccaccccttggatg

SEQ ID NO: 2476 - DNA, 201 bp, Homo sapiens
tcacctgcaatgtgtaggaggtaaatgaacctgctcaccctccctctcacccagccacattcagggtcatttgctgtagctcaggtggctgcggctagggyggggttgccaggtggaataatggtcatgcacagctgcccctccacaggggctgagcccagggtggcttcactggaagagggtgtgggacaagctgggtat

SEQ ID NO: 2477 - DNA, 201 bp, Homo sapiens
agtgagctatgatcatgacactgtactccagcctgagttgacaaagcaagaccatgtcttaaaaaaaaaaaaaaactttctggaaaaccttatttcggatrccagaagcaaaatattaactatttatttctctttgcactcctgttgtgaaaatcctcattatcttttaaataatatggatacatctggctgaatagaggg

SEQ ID NO: 2478 - DNA, 201 bp, Homo sapiens
tcaggtgcctacacagggtagctgggggaaattaaaaggagcagagcttccagcattttttcttttgtgaacaaccctggtaaaaagattttgtgccaacrgttcttggtttctcctctgacaaccagttccttcccctgctattcttacagcattcagagtctgcacaacagcactgacatccctgcttcatgtgcaact

SEQ ID NO: 2479 - DNA, 201 bp, Homo sapiens
aggtcaacatgcacgctgccgcgcagggagcaggctcctctcagattaagcagcgtgtgctgggactgcgggaggtgaggtccattgggtggatccactargctttggaagcagagagtttgggctggagatggtgagaaaccacatagtggttggagcattttggggtttgtcagaagggtcagggctgctggctggggt

SEQ ID NO: 2480 - DNA, 201 bp, Homo sapiens
tttttttttttttttttttttttttggtgatgttgccagccactgattgattatggattgaacaatggtggtattgtgatatcattcctgctcatttttgwgctgtcatacttctataaagagatactgctaccctgagaacagccttgtagaagaaaaaaataaaatgaaaaagtaaatataaaaagagatacttctctt

SEQ ID NO: 2481 - DNA, 201 bp, Homo sapiens
cattttcttagcaattaatgacattgagcagtttttaatgtgctttttggactttaatacatcttttttggatggttctttgcccattttaaataggattstctctctcttttttcttggagacagagtctctctctgtcactcaggatagaatgcaatggcacgatctcagctcactgcaacctccgcctcctgggttca

SEQ ID NO: 2482 - DNA, 201 bp, Homo sapiens; identical to SEQ ID NO: 1128

SEQ ID NO: 2483 - DNA, 201 bp, Homo sapiens; identical to SEQ ID NO: 1129

SEQ ID NO: 2484 - DNA, 201 bp, Homo sapiens; identical to SEQ ID NO: 1130

SEQ ID NO: 2485 - DNA, 201 bp, Homo sapiens; identical to SEQ ID NO: 1131

SEQ ID NO: 2486 - DNA, 201 bp, Homo sapiens
ttggccaggctgttctcaaactcctgaccccaggtgatccacctccttcagcctcccaaagtgttcggattacaggcgtgagacaccacgcccgggctcaratgttcatctctttcagaaataccctcagaggaacacccagaggaatgtttgactaactgtctgaacacattgcaacccagtcaagctgacacatagaat

SEQ ID NO: 2487 - DNA, 201 bp, Homo sapiens
ccatctccagtgtattgggttcagctcatttcctccccagcactgctactaatgttcaaggcattatttgttgaagccaggtgccgtctaagcaggctgtygagggagagcaattttttttttgagacaggatctctttctgttgcccaggctggagtgcagtgacatgatcttggctcaccgcagcctcgacctcccaag

SEQ ID NO: 2488 - DNA, 201 bp, Homo sapiens
atgctcatgaaatcaatgtgaaggctctgttactaccaagtatattcatccttattataaattgcaggcttggtgaaatgaccactggttaagtttattgrcctagtagaccaactctgagccagaccctgacaaggattttatttgttaccttatccacatatttttctttccctaatgagaagccatggtggcattttg

SEQ ID NO: 2489 - DNA, 201 bp, Homo sapiens
ttttcttttccaatttttgaatggacagctggatttttaagtgattttcagcatatgatcctaaataataataatcaaatgtgtgcatatattttacaagyagaactttgaaatatgtataatattaatatgtgcaaaaataacaaatatattgcacatattatatgcttaatgttgtaaacagtttacccatgttaatac

SEQ ID NO: 2490 - DNA, 201 bp, Homo sapiens
gggcctttgcctgggttttgcttgggcccactgggctcgttctgcccccttggcctggcaggctgtactctgctcatgatactggcctgaatcctatgccygccaagggcgagccagacacagagcagggaggggtgtgtgagtgagtgagtgtggggtccagccaactgtgcatacctaggcatgccagctgcagcggga

SEQ ID NO: 2491 - DNA, 201 bp, Homo sapiens
tctttaatttatgaagtcataagtgcatcatctcttttcttaaatatcaggttatcactagtattctaacttgctcttattttctttgctttaagtgagaygggttttaatataatgttcttaaataatgaagacaaagtttgcatctgcatagttagtgtttctaataatggcagaaagctttcctgtttagtgagagga

SEQ ID NO: 2492 - DNA, 201 bp, Homo sapiens
tattacccaaagaaatctatagatttgatgcaatccttatcaaagtgccaatgatagtttttacagaaatagaaaaaaagatcctaaaatttatatggaaycacaagagacccagagtagccaaagctattctgagcaaaaagaacaaaactggaggaatcacatgacctgacttatactatagagccatggtaaccaaaa

SEQ ID NO: 2493 - DNA, 201 bp, Homo sapiens
ttttaaaaaccatgagatactaatgcacacctattagaatgtctacattctgaaacactcacaacatcagatgctggtgagaacttggagcaacaggaatkttcatttatttctaataagaatacaaaatgctacaactaatttggaagatagtttggcagtattttacaaagctaaacataattttaccacatcatatgg

SEQ ID NO: 2494 - DNA, 201 bp, Homo sapiens
cagaataaataattccacaaaatctaatgatagaacacagaatactacatacaaaaatgaagattaaagtttaaaaactataatttcaaactattgatcartggtaatttgggcacctctaggttacttcacgggcatgtggaaaacaagcaaaccctttagagtgaatagaaatgattaataataacataatttaattca

SEQ ID NO: 2495 - DNA, 201 bp, Homo sapiens
ccgtaatggcagagattgctgtctattttactattggttgtctcttgcactttgaacagttcctggaacataatatgtgctcaatatatatgtgtagtatraacatttagaaataaatttattgtctgcaaactgtctataaggaagagcaaaaaatctcgagctgatgagtatggctcaagtcaaattgtgagaagtttt

SEQ ID NO: 2496 - DNA, 201 bp, Homo sapiens
ctcaagtggtgattcagatccataactgttatgcctatcaacctgtatgaacattgattttagctctggaatgtgccatcttgaacattttaccagctgaytgggctttgtgcaaatgtttattatttctaccccatcctacttctctttccgcgttttgttcttgatcagttatattcccttggggatcaaagcacttgc

SEQ ID NO: 2497 - DNA, 201 bp, Homo sapiens
ttcatcctgcatatgtaccactttgtaacctttgagcttcatcttctcattttctccttcccattttgccacccattttgccacccacaattactgtttcmttctctatgtctgtatatttgaacttctctgaccacaatggaataaaactataaattaataacaagagaaattttggaaacactacaaatgcatagaaag

SEQ ID NO: 2498 - DNA, 201 bp, Homo sapiens
attgagaatcttgttaagtgaggccagcactcttcttgctaattggtacttggattctttctactgatatatggcataatatacacatcttgagtttaatktatctactatattctgaaagcatctcatcctttcagaatattgcctctaaggaggtgctttacctgtgcctctactaaggtgtttagcactttactaggc

SEQ ID NO: 2499 - DNA, 201 bp, Homo sapiens
attcaaaatttcaaataaaactaagccatatatgttgttgtcttacatgctattatgagatgatacaaatgagattaataccataaatcaaactaagggartgagttccacaaagtaacgaaggtattttcttttgaagtttaggagagaaatgtgattggaggaggacatatggaaggcttgaaatgaacagatagtttc

SEQ ID NO: 2500 - DNA, 201 bp, Homo sapiens
ttttcttcttttctctctttctctagactgtttttaatttgtttgtttttaatatccccagttctcttatttttaccttcagattttcaataatttaaatrctgtcttctgttatggataatatgcttatgtttgtttgtttgtttgttttttccagctcacttattttctcttcattttcatatctggaagcagatacct

SEQ ID NO: 2501 - DNA, 201 bp, Homo sapiens
ccaagcccaaaatctcatctgagaaaaggaaagtcccttctgcctatgtccctgtaaaattaaaagcaagttagttacttcctagatacaatggggatagrggaattaagaaagtagacccatttaaaatgggagatattggccaaaacaaaggggtcacaggccccatgcaagtctgaaatccaataggcagtcattaaa

SEQ ID NO: 2502 - DNA, 201 bp, Homo sapiens
tcagttactataataaacattatttggtttctccttcatttaaaaaaaaattgaaggttcagaaaagtactaatcacatgatgacatgtcacatatatgtygatttgctttgtgaatgtaatagtttacacacacataaatacttcatatttcaggtatggcttatatgacttacatacattctacaaaatactttaaaag

SEQ ID NO: 2503 - DNA, 201 bp, Homo sapiens
gcatatggattgcctccataatgagttaaataatatattttacagtgtttattgtacgttgttattactctttttttttagcattttgccatttttatctktagcagtattcaagcatttgtctttacaaaagtcagatcagttactataataaacattatttggtttctccttcatttaaaaaaaaattgaaggttcaga

SEQ ID NO: 2504 - DNA, 201 bp, Homo sapiens
ctaaccagaacaattaggcaagaaaaataaattaaaaataattatacaggaaaggaagaagtaatattttctttgctgagtgataacatgatcttatacayagaaaagctggaagactccccaaaatactgctataaatgatttttaaaatcagtaaagtttcaggtgactaaatcaacttacaaaagtcagtagaatttt

SEQ ID NO: 2505 - DNA, 201 bp, Homo sapiens
aagagcacaaacaactcagaagtccctggacacgagcatgattatgcatttttccaaaagggaaaaacaaatgaagcaatgctaagcatcatgtgactcaygaaaattgaatcaaaataacaaagtaacacacatacacaaattctacaatcattaacatgctcattttgtaatatggtatgtatccaatcaatttgtaga

SEQ ID NO: 2506 - DNA, 201 bp, Homo sapiens
gctaacttacttcaaaaaggcttgggcccttaagagttgtgcttactctatcttcctgtgctctatacatagaaaaatgaaacctgagtgtctacacatckgtttacatcatattttatagaatattctaagtatattgggacatattgctcagaaaaaagattcctttcaaaatagtactgttcattgacaatttatctg

SEQ ID NO: 2507 - DNA, 201 bp, Homo sapiens
cataactagatgaatggataaagaaaatgtggtatatatacacagtggagtactactcagccataaaaataagaatgatatccagtcgtttgcaacaacayggttggaactagagatcattatgtttgtgaaataagccaggcacagaaagactaacgtcacatgttctcacttttttctggcatctaaaaattaaaacaa

SEQ ID NO: 2508 - DNA, 201 bp, Homo sapiens
gagcatttgggttggttccatgtctttgctattgtaaatagtgctgcaataaatagacatgtgcatgtatctttatagtagaatgctttatattcctttgsgcatatccacagtaatgagattgccaattgtcaaattgccattgtcaaatggtatttctggttctaggtccttgaggaatcaccacactgtcttccgtga

SEQ ID NO: 2509 - DNA, 201 bp, Homo sapiens
tgaggtagtattcatcatggtatttgttctctgaatactttggtgtgtgtttttttttttcattgtgcgattttttaggtcctgtgagatttgtgctttamggagattctcttttggtgtatttcaataatttgtttcaagatttagaggtccttttagcagtttttgtagtagtggcttggtagtggtaaattctctcag

SEQ ID NO: 2510 - DNA, 201 bp, Homo sapiens
tacaagttttacagtcctttccagaaagtttggctctttaattattgtgcataaaaaaaaaactttctggcttttttttatgaggatcataaaaaaaagtraagacaggctaagaaacttatgggacaccatcaaatggaataatgtacacattatcagagtaccagaagcagatagaaagagaaagaaacagaaaatata

SEQ ID NO: 2511 - DNA, 201 bp, Homo sapiens
actgaaaattgcattttagaagtaaatgtaggtatcaaaaaaaaatgaagtctgtagatagatattacattgcaattatcattccagggatgatagtagayacaccacttggtatttttttttaatcttatgagacccataaagggcagcctttgtttaatagcaccttttgacatttattacccttcttctgactttttt

SEQ ID NO: 2512 - DNA, 201 bp, Homo sapiens
aaacctggagtgtcctggtgtcctgggcaaattgggcaccctgtcttccattctttttatttgttggcgaatgagaagtttacattaggttagatgttttwaagcattcttttgtcagcaaactcaaaattaagacaaagttcagtgtgaagcatggacgggggcaggattccagttccccaccctctcttccacacacac

SEQ ID NO: 2513 - DNA, 201 bp, Homo sapiens
aactaatctcaacactctacaatatgttgtgtagatcctacatgtatgcttattaaatgaataattacttttcagtatataatataaattcaggcatcatsaagtatttatgtgtggtctttataaagcattgaggtaaggtattcatcaaagtatttttataaatagtgttaagagatacactttggcaaattaaaattt

SEQ ID NO: 2514 - DNA, 201 bp, Homo sapiens
ctaataaattaagaagtaatgatagactgaggattgcaccctctaataaatattgaatgtaggaataaataatgttgataacatgagaaaaagggagagaktagcacaagccttgtgtcctgatgggagaacacaataccacttacattcttcacaaaaatgtatcaaatttgcatctcatgaagtctctgtatctaacct

SEQ ID NO: 2515 - DNA, 201 bp, Homo sapiens
gttggagtcctatctctcagtaccacagaatgcaaacttatttgaaaatagagtctcacagacataaatagttaaaacaaagtcttactggagtagaatgrgcccttaattcagtatgacttatgtccttattaaaaaatgatatgaatatgtagggggagaatatcatgtaacaatggaggcagaagttggtgttattca

SEQ ID NO: 2516 - DNA, 201 bp, Homo sapiens
agtagaatgggcccttaattcagtatgacttatgtccttattaaaaaatgatatgaatatgtagggggagaatatcatgtaacaatggaggcagaagttgrtgttattcatctgcaaactaaagaacatcaaggattgccagctacaccagaaactaagagaaaggcatggaaaaaattttccctagaatattacttagca

SEQ ID NO: 2517 - DNA, 201 bp, Homo sapiens
ttattgaaagcctgctataagaactcagttcaataacacataaatggttttgcacagagcctgccacatagttgtccatcaataaaagtggctcctttcaytgtgaacttatcaaggtccctgttttcctcttccacacaattactgcagattcttttctgtgtttcatccttttttcatccattgccatactgagctaga

SEQ ID NO: 2518 - DNA, 201 bp, Homo sapiens
tcaaaatgacatattcaaaaattaataaatatacaaagctatagccattcaataatgtaaccatttactggaaactatctttaaaactgtagctgtgactycacaggatcatcatatgaatttaggaaaagtgaataaggaggaatggagggagtattttgcttaatcttaaagcctctttaaaataaaaaaatcaaagac

SEQ ID NO: 2519 - DNA, 201 bp, Homo sapiens
tactcttaggtccactcaaacatcttgcagtgctgacactatgtgtcagttagcaatctagcccaggggtttttcagccctggcccaaggacttccaggaracaagatcgtctcagcacagatgaaattctcatatacctaaaccataaaacaaagcttatccttaaaagtacagcttaaactccctttaagaaagaaaca

SEQ ID NO: 2520 - DNA, 201 bp, Homo sapiens
tctgagaatggtctccagatgtagaccttcttgggcagatagtcctctgacccctaactgcatctctctatctggcccatgtcacaagactgctttcactrtctgtggtggcatatgccacaataaactgcttgagtatcagagggtatctaagtctctttttgttgtttgcttgtttttggacatggtctcactctgtag

SEQ ID NO: 2521 - DNA, 201 bp, Homo sapiens
aagctagacaaatttgggttctgaaatatgttttgagtctagtcataaactcaacaggcattgagttgaaatgtaaaggacaggcatgctacgcattcaayctgcatgggatttgagtcatatatgattaattgaaacacaattttattatttctatgttgtaaaaacatgaaaatatttttaatataaaacattttagta

SEQ ID NO: 2522 - DNA, 201 bp, Homo sapiens
tgacagagtaaaagcaaaaaactctgactcagaacatgggaaaagactgatggctggaagagcttgtgagagtccacatcaatttgcttcagataaaaatragtcaagaactccatggacaggggtgcaatgacaccaacttgcagcttaatagaatatggaagggagacttcagataatactctgtttactgccaaaatc

SEQ ID NO: 2523 - DNA, 201 bp, Homo sapiens
cttaagcttttcttcacagcactatgaaaatggactcacacatcctttcactgggataattgagtaactgagacatagcttcatgactctgaggtattggwtgcacacacaaacacacacacacacataattgactaactgcttccatgttatattataaattaatttcaaattcttacatgttaaatataggcttcatat

SEQ ID NO: 2524 - DNA, 201 bp, Homo sapiens
tctccatatgagaacattttaatatgaaatcaaataaactgggattatggaaactcctattgatttttaaatagtgttctataattttacagttttctatsttttgagaaaatatctgacaatgttaatatttttctgtttataaattacttataagcatctatacattttaaatgatacatctacaatagaaaggagaaa

SEQ ID NO: 2525 - DNA, 201 bp, Homo sapiens
tctgacccctaactgcatctctctatctggcccatgtcacaagactgctttcactatctgtggtggcatatgccacaataaactgcttgagtatcagaggktatctaagtctctttttgttgtttgcttgtttttggacatggtctcactctgtagcctagtggcgctactctagctcaccgcatacttcaacttctgact

SEQ ID NO: 2526 - DNA, 201 bp, Homo sapiens
ttgatgaagtaattaccatcccactgtacaaagattaaaatatagaatattaaagactttgctggctgctatatggaaaatgaattgattagagtgaagaytgatgaatcagaaatatcattttgtgagtcatacaaggcatgttaatggcttggacatggaagacagcaacagtgatatgtagaactcgatagattcatt

SEQ ID NO: 2527 - DNA, 201 bp, Homo sapiens
aacccagatggtctggctctgtattggtcttgagtccttctcacatcacatcacatatcatctgacctcttccatagccacacctttctttgactctgtcytttctgcctctcttttttcaatttgaaaaactcttgtgattatgttacatctatctgtataatctggaatacactctctattttacagtcagctgattag

SEQ ID NO: 2528 - DNA, 201 bp, Homo sapiens
aagcagtcgatatttatggagtacctgtctgtgcaggcactgtctaaaaaacaattattccaaatgaagaaagctgaagaatgataaatacagaaaaacaragaaagagaacacaaccatataagagaaacacaaatcatattttcttaaaaaagaggattaagattggcatttggaaagaactagaaaataagaagttat

SEQ ID NO: 2529 - DNA, 201 bp, Homo sapiens
tatatatatacgtatatgtgtgtgtgtgtgtgtgtatatatatatgtgtgtgtgtgtgtgtgtgaatctgtcatcttgaaataaccctgagcttgaaatcktcatagaattagaagaagaaataaaacattaaagaggtgaattgacaacatgtctaaaaagcaagtggcatcttcacgtcttatttattttccatctatt

SEQ ID NO: 2530 - DNA, 201 bp, Homo sapiens
agccatgaggagggcattgataaccttaagtagggcagttttgggggctcaggttgggaatacctggctggagtgggtccaggagagaacaggaggagagraattgaagacagtcatttctttcttaaaaaaaggaaaatgagaaataggaggataactgaaagagaaaatgtcttttattttagattctaatatgggagg

SEQ ID NO: 2531 - DNA, 201 bp, Homo sapiens
ttcttgctttctgaactacagttgtattttgtgtcaaatgggagtattagatttcccatgtctcactgagctgtattaatgatcaaataagagaattacawgaaagtatctgtagaggagggcagagggagagaactgaatttgcctcatacaatattactgtggttgttacatattatccttgttttagctgctaggaat

SEQ ID NO: 2532 - DNA, 201 bp, Homo sapiens
aattgggacacacggatacatagaaggaagactatgtgaaggcacagggagaagagagccatctgcaagccaaaaagaaaggcctcagaagaaaccaaggyctgctgaaacctggatctcagatttctggctctagaattgtaggaaaatacatttctgttgtttaggccacctagtttgtggtgctttgttacagcatcc

SEQ ID NO: 2533 - DNA, 201 bp, Homo sapiens
cgtaccaggcactgccgtgaatcatttacatgcatcaatcattgaacaaccctatgagatacccattacgattagcccagtttagagatagggattcttaygggctgaattgtgtcttcatatggatctgcccaaattcattatggtgaaattctaaccctcagtacctcagaatatgagtatatttggagatagggtctt

SEQ ID NO: 2534 - DNA, 201 bp, Homo sapiens
ttcagcaggaaatgcagtatagcatattgttttagacatagactctggacttgggcctctatcctacctcaaatgacttagtttcctcatctataaaatgrcatgatgacactgtctacctcatggggttgttataaaatttaaatgattgattgaatgtttataaaagtcccacacaatacccagaacatcagtagtttt

SEQ ID NO: 2535 - DNA, 201 bp, Homo sapiens
atcctctcagaagtgtgagcagacaggaactgacatttctagaagttccttgctaaccctcattgcccttattgtgaaatgggaataaaaggactgctttraagatcaaataagctaacctatattaaatacctatattagttccctaaggctgccgtaacatattaccacaaacttgatggcttaaaacaatagaaattt

SEQ ID NO: 2536 - DNA, 201 bp, Homo sapiens
gcccacagctccttctttcagggctttccctttgatcgttactttccccttctttctccccatctcccatactgtatgtcttccctctggaaagtctcggratgtctaagatgacactgtgcacacagagggtgcttgtgttggttcaggtcttccaagaaagcagataccaagacaggactcggcacatacgagatatgg

SEQ ID NO: 2537 - DNA, 201 bp, Homo sapiens
aaaaaaaaaaaaaaaagcaaagacccatacacacattataccagataaacaaaacatggctatgggccacatatggccattgggctttcagcttgtcatcwgtgacttaggcttttaaagccatagagactatctttttttcctcttgttcatctaatgatccctgctgaggtaagaagcagtgagtctctgcttaaatgg

SEQ ID NO: 2538 - DNA, 201 bp, Homo sapiens
ggtctcgaactcctgacctcatgatccacccgcctcggcctcccaaagtgctgggattacaggcatgagccactgcgcccggcctctgtcaagtattaagracttagactgtcaaagctgtttctaaagctatacacaaaaccccccatggaattctaaaaggacccacacctatggtattgggttgagtgtacaataatt

SEQ ID NO: 2539 - DNA, 201 bp, Homo sapiens
cacaaaaggagaagccttcccagccttaatgtccaaagggaggcatagaggctcagggaagctaagtgacttcaaggatgctaaggctccagtatttatayagtgatcaaatatcacacttgtacaaagcaatctcaggtggaaagacccactcctgaccatggggatgtgggactttctggcattgctaactgctcgggg

SEQ ID NO: 2540 - DNA, 201 bp, Homo sapiens
aaaggagtgacatctccaaggatgcctggctcgtggtatcgctcagcatattgtttctagatgcacttgtgcattcatgatgaggaggaggatggatcttkgagctggaggaaagatgccacaaggacccattctgtccagcacaaaaggagaagccttcccagccttaatgtccaaagggaggcatagaggctcagggaa

SEQ ID NO: 2541 - DNA, 201 bp, Homo sapiens
gtcttagaggcctccagccaaatattcctcacctggttcgctcactcccaaaggggtcccctgtgaagcctctgaaaccttatgcaaaatcctgtgctcawgtatattttccagggagatggtggctgatctctatcagagctccaaagagggccatgatgcctaaaagtccctatgggattcagaaaggagtgacatctc

SEQ ID NO: 2542 - DNA, 201 bp, Homo sapiens
tgcggagcattcgtcagcagagggagatggtaaaggggctttcgcatccagttgaggtaacagaaaagctgacagctcgtgagggactctttcccaccctrcgatggtgctattcatgccgtctcagtttccatcttcagttgccctctctcccaggtctccgactcagggtttcccccacgaggccaccattgctccagg

SEQ ID NO: 2543 - DNA, 201 bp, Homo sapiens
gcaggggtggggcccacttttaaggaacattcctgtgtatttccatttatactttttttggcttttggaattcaatcaaaacaaagaatttggggaagaaragatgtgaaaacaaaacattggcattagattctggccagacgctgttgccagctgaagttgctaaacctgaggcttctctctgctgcggagcattcgtca

SEQ ID NO: 2544 - DNA, 201 bp, Homo sapiens
atgcaaaaacacctatttctgtagcttgcatacgcataaggtatttctggaaggacatagaagaggtgcatagtgattacctgtggggagaagaacccacrgctaggggcaggggtggggcccacttttaaggaacattcctgtgtatttccatttatactttttttggcttttggaattcaatcaaaacaaagaatttgg

SEQ ID NO: 2545 - DNA, 201 bp, Homo sapiens
attttgtcatcactgtatttactaacactgcacatcaaagcgattcctacttcttttaaatggaaacacatttattttaaaagacacccatagattgaaascataaatggaaaccagtctgatttgccatacagactaatttttaaaataaatgcaaaaacacctatttctgtagcttgcatacgcataaggtatttctgg

SEQ ID NO: 2546 - DNA, 201 bp, Homo sapiens
gtacacacctgcacccacgccccccatgcagcatggggagggacggcatccaggtgatacgttctttctggatgcaaatacacatcagttatgacctgacstgaaccgccattcccttggatgtagcaatagagacagagaggccccaaacgcttctgagcctttttggtcagggtctctgcctccaactgggtctttctg

SEQ ID NO: 2547 - DNA, 201 bp, Homo sapiens
taaagttgtctcatcattttggaattcaacacagctcctaaagctgttgataagaattgtacgtgcttctgagttatgtgggctgatttcgacggtctgcwtatgaggtaggaggtgggactctattctagaggcagggctcaaactccagaccagattggagactggctgaaacaggggaggggcaaaagcacctctcca

SEQ ID NO: 2548 - DNA, 201 bp, Homo sapiens
ctgacagctcgtgagggactctttcccaccctgcgatggtgctattcatgccgtctcagtttccatcttcagttgccctctctcccaggtctccgactcakggtttcccccacgaggccaccattgctccaggaacagaagttggaactgaaagcagtcttagaggcctccagccaaatattcctcacctggttcgctcac

SEQ ID NO: 2549 - DNA, 201 bp, Homo sapiens
ccctgccactgtatagtaagatggtggtcaggacctgggggtgccaatgactgatctcaaccatacctctaagctgagaagggaaaggtcactgattattmcttaagccagacttaaagaacagtcccaaagcttctgacagccaagacaatgtcctcttcgctttcaatgacaaaggcccaactgagtaacatatgaaca

SEQ ID NO: 2550 - DNA, 201 bp, Homo sapiens
aatacaattagacctctgaccccagatcccagcgagtgctttgaagagaagagaacgatcaagcctcaaagctggtcagtctgtgcggctcactctggacsctgggtgtgggccccagttgctcccctagaagagtaaagagtcagggtcccggattcccttgggaacctccttctgctctctggcctcatcccatttcac

SEQ ID NO: 2551 - DNA, 201 bp, Homo sapiens
cagcattgcaactctgggcccagcttgcattattctggcggtccttcagtggtaggcatcccctatctgatcaaggtccagtctccagagaaggagatagmtgaggtgtgctagcagcctcatgcacacccacagaagggaagggaaaggggacctgggggaacaccaacctcaacactgcagcacctccctccaatattc

SEQ ID NO: 2552 - DNA, 201 bp, Homo sapiens
tctatcatctctcccaagtgccaccatctaatgatctgtgaatatttactgaggacagaaaggagagggggaaaggagaatgttctaagtcaatcagtcaygaatgaagatgaagccatggatgcacactgcgtgttctacaaactttgcctgggggcaaggagcatccagtcaacaggagatatcatttttggaatctcc

SEQ ID NO: 2553 - DNA, 201 bp, Homo sapiens
ttccatttgcctctgagagtagaactaagactgaggttggcagcactatgacagcagagattgaaaatcattggtgtgggggccacgttcacctcccagaraatatttagaatgtttggtttggcctgtacagtccttaagacacgtttaagataaagctaacatcaaaactttaaaattgtacataaaaataaagatttc

SEQ ID NO: 2554 - DNA, 201 bp, Homo sapiens
tagtgacctggatggaagttctgacaaagagagaagtaaaaatttgctaactatttgtagcctgttgatgaaaatacccagagaggatgcagaaatgtctycaactctctgaaggttcttcttatagagaagggcatggaacgtttccatttgcctctgagagtagaactaagactgaggttggcagcactatgacagcag

SEQ ID NO: 2555 - DNA, 201 bp, Homo sapiens
gtttgaagggtcttgggccgagcagatagtgacctggatggaagttctgacaaagagagaagtaaaaatttgctaactatttgtagcctgttgatgaaaayacccagagaggatgcagaaatgtcttcaactctctgaaggttcttcttatagagaagggcatggaacgtttccatttgcctctgagagtagaactaagac

SEQ ID NO: 2556 - DNA, 201 bp, Homo sapiens
tctttttcttaagcccaaattttcttaagaaaaatactcaagaaatgttatctttaagccatgaaacctctaagcatatacttcatattaaccttttgagygtggacctgggtagcatggctcttaatgctatggtcagtaaaagtcaaggtttgctggcaaacccctccctagacagtgcttgcatcatgtcacacaatg

SEQ ID NO: 2557 - DNA, 201 bp, Homo sapiens
aagaattcaggcagggtgaggggactgagagtgatggggttaggggtgatagtctagataggatggtcagagaaggcctcattaggaaaatgatatgtgarcaggcttcagtgaagtgagggagggattcggtaaaagatctggaaatgcaaggatccaggcagagaaacagaagatacaaatgcttggctggaaaaactg

SEQ ID NO: 2558 - DNA, 201 bp, Homo sapiens
ggactgtgttcaccacagagaggcccagaccagagggatgtggtgggatgggtcatgagccttaacgcagtctgagtgtcctcacttatacttgagcttartgcaagggtctctaaaggctgccatccccaaacctgctaccatctcaccaggaaagtgacagcagctacactggctaaatagaataggtaaatgttattt

SEQ ID NO: 2559 - DNA, 201 bp, Homo sapiens
taccatctcaccaggaaagtgacagcagctacactggctaaatagaataggtaaatgttatttgcaaaagcatgcaaagactagaaaagagctggtgagtyagatatctgagttctctagccatctatcatctctcccaagtgccaccatctaatgatctgtgaatatttactgaggacagaaaggagagggggaaaggag

SEQ ID NO: 2560 - DNA, 201 bp, Homo sapiens
caaagcttttctctcctatttctacttaagtaaaaatctggccagtttttccaaaaagtaaacttcaaattaataaaactattttgaaaaacacttttatyatatttatttttttcttagaataatggtaaacaaattcattgtaaaaatatggaggcaaaattgtattaaaattatataaaattgtctttaactgttgtt

SEQ ID NO: 2561 - DNA, 201 bp, Homo sapiens
agccctgcagacccagaaaaccacgatgtagtcatcacatcgactttgtgcgatgcttctgacacagcagaagtcctcgctaaattcgtgtgatgttccartgaaaacagacatacatttttattataggaccttattactcaggaaggtactgattgatcttcagaccaggtggatcactcagaacactgatgagccttc

SEQ ID NO: 2562 - DNA, 201 bp, Homo sapiens
aagacagggaatatacttcctaaagccaagtcacacacacaaaaaaggtcctctttaactcctggcttcctgccccagtgccattaagttccatctctagycttctcaactacagattatagtcttctgtccaatatggtacccattacccaatgggggcaatttcaaattaaatcaaaattaacattcggtttttttggt

SEQ ID NO: 2563 - DNA, 201 bp, Homo sapiens
ctcagccagagaacttctaagagtgtgtggttcaaggattttttttcctacttggtgtaacagtgatgaacatcagcaaatagtcttgaggctttaatttmaaggtcacttaaatcttacccaatctagagagaatcacattttacagatgagaaaacagaggctcagaccacctcatgcagcaggctttccccagattca

SEQ ID NO: 2564 - DNA, 201 bp, Homo sapiens
cccacatgatctcttttctacatctctgtagctctgcttaattctgtttgaatgacagaagacgctagtcttcaagtatttggatacttactgtgtgcaargtcaggactgctcttctagtcatttctctgcttgcatttacatcaattcctcatccttccttgctctgcatataaagagccctgtaggctatgtttccta

SEQ ID NO: 2565 - DNA, 201 bp, Homo sapiens
ttctgttgtatgcatgtaccatagagcatttagggaaaaatgggaaacctaatactggttactaaaatgcctcagtagctacatctttgcgcatttacccsatgacctgaagtcttgcgctattgcagatgtgttttctgtatctaagtgaaatgactcctaggcaccaataacagactgtcagcttgggtttgcataact

SEQ ID NO: 2566 - DNA, 201 bp, Homo sapiens
ctgtgaaacacagagtctagctcttattttcttctcagtaagacagatagttccttcctttgtgaggtgtttgcaagggttctatgggatttaaacacttstataaacacgatgtgccaagcactgttctgagtgcctgctaaaacatttgctggagtctcagaacagtcctacaaaatagatactattatttccatttta

SEQ ID NO: 2567 - DNA, 201 bp, Homo sapiens
ctttccccagctggaataaaagatgtagcagagggggaagtcagaccccaagtgtaaggatttgatgtactcttgctagctctgaaatgtaggggccccaygcaagggcccaagagagacctctaggagctatggatggacctcagtacacagccagcaaagaaatgggaacctcagttcttgagctgtgaagaactgcat

SEQ ID NO: 2568 - DNA, 201 bp, Homo sapiens
tcctcacatacaggcctggcccctggcggcacctgagcttaacacttctcgtgtagggaaaacactgcgctgggactcttgaagaatcgggctgtcttcasatgtaaacactttgaggttcagaaaagcggaggttggatgcagagcaggtcagtgaatcgggaacttggttgccaagaccgcctgttccttgtggaagga

SEQ ID NO: 2569 - DNA, 201 bp, Homo sapiens
aaacatttttttttttttttgctgttgagttacgtgagtttcttatatattttggatattaacatcttatgagatacatggtttgctaatatattcttccrctccattggtgcctgtgcattttgttgattgtaccttttgctgtgcagaagctttttagtttgatgtaggcccacgtgctcacttttgcttttgttgcct

SEQ ID NO: 2570 - DNA, 201 bp, Homo sapiens
ctgcttcagcacttcagatgcagaatgatggccatgggcacagcagtttaggattaggtgaactgtgatgagcagttggtgcttttccttgattttgaagygcctgtagggcttggcaggttggagcgctaggaggccagtgtctctggagtggtgcaaggtacagagcaaggtacagagctagtgcaaggtacacaataa

SEQ ID NO: 2571 - DNA, 201 bp, Homo sapiens
ttgacatcagagaccaactctaatctctcttctccattacagccctttgcataattgaagaaagctgtcatgtttcccagagtctcctcttcatcagcccyacaaagtgtcagttttcccctctggacgagcccctgcctgccttgcttgtataagtcagccctttgcagggaacgaagctatgggagaagagatttgtct

SEQ ID NO: 2572 - DNA, 201 bp, Homo sapiens
cagcttaattttaagagtattttaccacaataaaaattgcatagatctacacacatgagtacacacacggcacacacatatacacacttgggagcggggarcgggagtgagtgcatttgaagctagtgaaatctgaatgaagtttgtagatgtaccaatgcagttttctggtttgatattttactgtagttaagcagggtg

SEQ ID NO: 2573 - DNA, 201 bp, Homo sapiens
ttatttagggggattaagtgttctttacaagggaaaattgaagcctggaaacactgagtacctttcccaaggttagacagctggtgaatgcccaagttagsatccagacttattttggagaggcatcaaagtatggaaccatgagttcctggggtcaaatttaggaagacgccaattttactacctttgttgatctttagc

SEQ ID NO: 2574 - DNA, 201 bp, Homo sapiens
taaatctattgtacatgcttgtaaacaatagacaaattgcgtagtgtaacacaaaagtcagcctaatgtttgtacatggtggagatattgattagttaaartttatttcatgtatccctactattgcattgggttttcatatgtttccttcttcttcttgtgtgtttgttattcttatgtctggttccagttaatacttct

SEQ ID NO: 2575 - DNA, 201 bp, Homo sapiens
gctgttgcttttctgggattcagaagctgtgggctaggaatcactaattacatccctgcaaattgggttctcctcttctacccctttgcctacttgaaaayctatgaagattcattcaggtgaatttctaaccatctgtacctcctcccctacacattagcaaacacaggatgctcccttagaaacataccaattgtgagt

SEQ ID NO: 2576 - DNA, 201 bp, Homo sapiens
gaagccagagactaacttggatagtctggctggcagtggaagaactgcagagctataatttgtttaagtatgggagaccagtaaagtcactggacttgttsattttctgagaggagaaagtggattgctttgaaatccccctctcttcctcctccccatgaatgacacccagttgttcagttttagttcttgccacagctt

SEQ ID NO: 2577 - DNA, 201 bp, Homo sapiens
caggaataccaggagtcatggatcattgtgaataatcttgagggttggctgccacataagttatcctttctttttcatcatttattatgaaaattttgttktgtttgaagtagattccctctaagaggtcttgatttggtatcaattatcatgagagaagtaggatctcctacaccagtcttttgttcatattcttaccac

SEQ ID NO: 2578 - DNA, 201 bp, Homo sapiens
agtgattccataataatcaatagcaataagggtaagagtccctaagagtagcaattagagacccaggcatgacccccataagctcccacttagtgtatgcrtgtgttttctgctcttaagtggagtttgggcatgagagggcagatctgttccactgtaatgcaggtgtgtgaggctgaggtgaggggatgcaggatgtgg

SEQ ID NO: 2579 - DNA, 201 bp, Homo sapiens
tgacatcatctggtgggtccagattcatttccatgtgactgtcctggctctcttctccacatccccaagccatcctaaagatggctgcagcagttccaaarctctcttctcaacacaccgtctagaagaagagagagttgtttcttgaaagctgcagaagatcgaggaagatcttttccaaaagtgtccatgaaagttatc

SEQ ID NO: 2580 - DNA, 201 bp, Homo sapiens
aaaacagaacttatttaagtagcccgttgttatttcgctattaatggaattattaaaaataatttataataaaacaacttggtaggtatatattcagatarctttgcttgcatattacagtccaagggtttatccttaggaaaactaagaaaggaaatctgattcattatttataacttgtaagacagtagaagtataacc

SEQ ID NO: 2581 - DNA, 201 bp, Homo sapiens
tttatgtaaaataaatttagcatctggattccttagctgattctctatgctggtgtttattgttctgcaagtagttcagaactcagaggtgctggcttgtytgttttatcatatccgaaaaatgtgttcttttgcatttggaaatgaagctactgacctcctgagttcagggcatgggctgaggtattttcttccattatg

SEQ ID NO: 2582 - DNA, 201 bp, Homo sapiens
ttttcttccattctgtaggttgtctgttcactctgttgatagtttcaaaaaagaatatgttttccttaagtgcctgctggtggataggaaaactcaagtgrgaatgaccttttcctcaatcatttatgaaaccagtgggaagcaatttaattactaccctcttttaatgaacctgaacgtaaggtcatagtatgtggtagg

SEQ ID NO: 2583 - DNA, 201 bp, Homo sapiens
atgtaaatatgaggtgtttatggaaacacagaggacctagaatcaccaagatacttttgttttcatttctttatttttaatttttagacttggggggtttsttacgtggatatactgtgtagtggtgaggttttggcttctagtgtacccagcagccatgtagtggacactgtacccaatagataattttttaagccctca

SEQ ID NO: 2584 - DNA, 201 bp, Homo sapiens
agtgagaatgaccttttcctcaatcatttatgaaaccagtgggaagcaatttaattactaccctcttttaatgaacctgaacgtaaggtcatagtatgtgktagggcagggcctggtgggggggctccattttactttttagaaggtgtatttcattggttgccaagacttctgacctattattttgtgagctggttatgt

SEQ ID NO: 2585 - DNA, 201 bp, Homo sapiens
atctgctgttttttttatctttttaataatagccattctgactatttaaaaattatagctcattgtggttttaatttgcatttctctggtgattagtaacratgagcattttttcatgtttgtttaccacttgtatatcttcttttaagaaatggccaagacagttttgaaaaaagatgacagttttgaggacttacgtta

SEQ ID NO: 2586 - DNA, 201 bp, Homo sapiens
atggaagggtggaatcatggtgagagaatgtaagctggtctaatcttgtgcaagagagttgccaagaatggcaacatttttagcttctgaaggaaggaccygtgctctttaatgttaagcaaatacttctatcattcttactactaagcaaaacttgctaatggctttagcccttgggaatatgtaaccaaagctcttttt

SEQ ID NO: 2587 - DNA, 201 bp, Homo sapiens
aaatatatttttagacaaatgaaaactgaaaagctgtatttcccacagacccaaatggaagtgtggagatgtgggattgaataatatatttcggtgacacrtgtttgagttccttgaacataccatgggggaaaattttcttcctgccaagagtgtttgaggcacattctgtttactctgtctgatgtttttctcacatct

SEQ ID NO: 2588 - DNA, 201 bp, Homo sapiens
gcattctgatttcatctctttattgagagtagtttatcaatcatcttttcattattagaaaattttcccataaatccccacaaatcatttttataaaaatrtatttaaaattatataatacaatttgctatgtagtatgtaatttcatgcaagggacttgtgtcagtgaagttgtttagttgctgaaataataatagttaa

SEQ ID NO: 2589 - DNA, 201 bp, Homo sapiens
tgggtcatggttttaactaaccattccatgactttggacaggttccttgttacagattgaatcattgagcctagtttttcaccctctgttatggaattctsttccctggccctggcctcacgctcattggagcacacttccttgactttgggcatggccccgtgacttgctttggctgatgtctgtatcctcgggttctgc

SEQ ID NO: 2590 - DNA, 201 bp, Homo sapiens
catcttgactggtgtttgggcgctataacctaatcaagttgacacttaaaattaaccatcacaacatatattaatggggttgcctgctctatgattgggcrggcccacagtgatgacatgatatagactttgcccttgtggggcttagcgtccagtgactgttgttttgttttatccttacagaagccctgtaaagatgaa

SEQ ID NO: 2591 - DNA, 201 bp, Homo sapiens
taaataagtgtataagggcttaggtactgtttactaaaggccatctctgtggtgaatatgctgtgtgatttactttatttttatttttttacctcggagamgttctcagaatgatatgcttttttaaacgttcactttattttatttattattattttttgagacggagtttcactgttgttgcccaggctggagtgcagt

SEQ ID NO: 2592 - DNA, 201 bp, Homo sapiens
ttcaaaagcgaatagaatgttttttaggtttctcacttgtctgtaaaaggccaagtattcatacttgggggagggctgttcactgatgctgtatttaaatkttcatgaggacaggattttcgtgcctccctgggtaggtggttctgatgctaattagcgagaaggtgtttgctctatgcatgggagcacatgtgagcacgg

SEQ ID NO: 2593 - DNA, 201 bp, Homo sapiens
aggctggaaactcaggcagggtttctctgttgcagtattgaggcagaatcccttccagattgggaaacttcagtctttgctcttgaggccttccactgatyggataaggccaacccacattatgaaagggtcattagctttacttgaagtcaattgatcatatgtgttaatcccattaaaacaataccttcacagcaacat

SEQ ID NO: 2594 - DNA, 201 bp, Homo sapiens
agactgacacctgcagctcttgaaattctcaggcctcctggctcatcatgtcggtgagggaggagcaaatgaacaaatttcaaacaagtcataattaacakaagttaaaacacattaaattaatagctgaagaccatgaatttaaaaaccctatgatgatagcttaacagtggccaagctaaattaagaaggttaaaaagg

SEQ ID NO: 2595 - DNA, 201 bp, Homo sapiens
tctcgacggactttcatcagcaggagaattcaggccttacaaagggagggatgggaatagatgaatgcatccttagatttttggatttcaggaaccagatmttcctgggaaaactaccccaaatttattttgacaatccagtggttttaaaatagcctcagtatcacctgccaccatcagtgtcattctctccacgttttg

SEQ ID NO: 2596 - DNA, 201 bp, Homo sapiens
aatagcttgtatttgcagtgctttgggggtttgaggtggaagaatcatttgaggttgaaggatcatttgaggtcaggagtttgagaccaccctgggcaacrtagcaggaccctgtctctaaaaaaaaagaaaagaaaaaattagtcaggcatagtggcatgcacctgtagtcccagctgctcaggaggctgaggtgagagg

SEQ ID NO: 2597 - DNA, 201 bp, Homo sapiens
tggcccacatgattgtgagggctggcaagtctgagatttgtagggcaggctggcaggcttagaaactcaggtagagtggatgttgtaatcttcagtctacwgtctgcaggccaggaaggctggaaactcaggcagggtttctctgttgcagtattgaggcagaatcccttccagattgggaaacttcagtctttgctcttg

SEQ ID NO: 2598 - DNA, 201 bp, Homo sapiens
gcctgaaacttgatatttgagcttggcctgaaatatgaaatttgatgggtaggaagtggctggaaccatgacttcaagcagagagccagcttgagcaccgstatgaaggggagagtccacactgcattcagggaatgactggagacctttggcaaaatccagggtgaatgagggaggactttatttagtagggaatgagtc

SEQ ID NO: 2599 - DNA, 201 bp, Homo sapiens
taaaaatatttcacttgaaaaatctgagaaggcctgaaacttgatatttgagcttggcctgaaatatgaaatttgatgggtaggaagtggctggaaccatsacttcaagcagagagccagcttgagcaccgctatgaaggggagagtccacactgcattcagggaatgactggagacctttggcaaaatccagggtgaatg

SEQ ID NO: 2600 - DNA, 201 bp, Homo sapiens
ctgttacgtataggatttgtggggtattgggatgggttgaaaaaagtacaggtaattgcaataactcctactagtggagttgagaataattggccttttayagctgtttgttttagaagaattagaatagtggagtgggcagacctggagtcaggtggacctgggtcatggttttaactaaccattccatgactttggaca

SEQ ID NO: 2601 - DNA, 201 bp, Homo sapiens
ctgaggaaagaaaataaacaatacttaacattagttaattaatatgtctgtaaaaatgaacaactttgacataaaaagcggtaaatatggtttgtagggcragaaagacaatgttaaatttgtctgaatatcttttaggaaaatgaaaacctgataaattcaatctaaaaaaaccaaaaacatatctcaaatgttaaactg

SEQ ID NO: 2602 - DNA, 201 bp, Homo sapiens
ttgaacatgcagatatcttatgcattgtaagttgtgatagaaactgatacaactttttacaaatacaattcatgttggattaaatttagttcatatggtgrcacagtattctcttggtgccactttgccagctggaaatctccatggctggaggtgcttcttctcagtcttcacttgggccactgggcttgctgtgcccac

SEQ ID NO: 2603 - DNA, 201 bp, Homo sapiens
aactgatgatatttcctactaaggttcatacataaaggtccatagaaaagcatatattttaaaacatattccaagattgaatgtgttgatgtgacatcatsgaattataagattaattagtttacttcactttagaatttttaatatataccctaaatagatattaaaaattgaaaggaagtaaaaaaggtataggaactt

SEQ ID NO: 2604 - DNA, 201 bp, Homo sapiens
caaaagacttgttccttgcctcataaaatgcatattttcaaccttgaaatataaaaatcatttttcttctttctgacagataaagccattttactttgctrcaaaggatatagactacaataactgacaatcataaatatatacggcaaatgtccttgctctattatacgtatattaaacctacttaaagataagcaaagt

SEQ ID NO: 2605 - DNA, 201 bp, Homo sapiens
agggacagtttctgcttcttaactactccatttgcttaaaaattgttatttcaaaagcaataaataaataaataaataaaaagggatttagtttttctgaycttgaggaaataaaaatcaacaagaggtatgaaactgttcttggttttaacaggattcatcatctaagtataaaagtgacaaaccataaaaataaaatgt

SEQ ID NO: 2606 - DNA, 201 bp, Homo sapiens
gtgggtttctaattgtatttaattcaagaatcaacctgatttatttcttcaggcattggaacaaacaaaataacatttctatttcctgcagcaaatactgycacctcatagtatattttgaagttcagtaatgtgatgcatccaacttttttctttttgcttaggattcctttggctattccaggtcttttttcttttcat

SEQ ID NO: 2607 - DNA, 201 bp, Homo sapiens
ttgaaatataaaaatcatttttcttctttctgacagataaagccattttactttgctacaaaggatatagactacaataactgacaatcataaatatatayggcaaatgtccttgctctattatacgtatattaaacctacttaaagataagcaaagtaaaacttcagtaaatcgtggtctgatttgggtatgcagacaat

SEQ ID NO: 2608 - DNA, 201 bp, Homo sapiens
tggcatatttcttggaaatttccttgctattaaacaagagggaaggtgatacattttggaactccaggtgaagatctcattacaaataaaggctcaaaatscttctttgtgctttctgatttggttaagacttatttagacctattccttcaacacattaaccaggtaattaatgactgtcagttttgaattgtaattaga

SEQ ID NO: 2609 - DNA, 201 bp, Homo sapiens
cctttacaaaattccattcttaatgtggcacatgccaatatacatggggcattttaatattggatttctgtaagtgatatcatgaaacattatagaaacaytctgcatccaacttgactcctgttggacttcttgtgcagatatcatctagctatgtcattctacaagcacaatgggtgcgacagcaatctcacttcttaa

SEQ ID NO: 2610 - DNA, 201 bp, Homo sapiens
tacacctcctaagctatatgtctacatgtaagtgtgcattcatctaaaaacataaatgattaacttcttttaatctctaagtaaggtctgaatcttgaagmctttcctctgcagcctcaatacatttacttaatctaaatgggtccaggtgcttgggtgattacgcttatcttgtctcctgctaaatcatgggaatttggg

SEQ ID NO: 2611 - DNA, 201 bp, Homo sapiens
gaggcaatttataatgatgcagctaattataatttcctcagctcttttttctgtgttttctgctgtccttcaggacatgataattttctaaaacatctctrctagatacttagtaagagaacaaacaatgtattacttgttatttcatgtaaggtactttcccaagaaaaaataaatacctagagttaagaaatcttatta

SEQ ID NO: 2612 - DNA, 201 bp, Homo sapiens
ctaagccatatgggcttgttttaggaagtaggaaagggtaggaatggataaagaagatgcaggggacttttggaatgccgatagtgttgtggtttttaaaygtgttggttacatttatatttgctaaatctcatcaagctgttctcatataatttgtgcattttcttttatgcatgctatgatttaaaaaaaaggttatag

SEQ ID NO: 2613 - DNA, 201 bp, Homo sapiens
atcatcctaaaatgtatggaaatcatagattctaacactatattgtggttaaaatttcatctttatgatgtattataggtacttttcctatttgtaggcawgttttatgtcaattgattttcttaattaaaatgtttcctgaaaatttcttaattattcaaaaatataaagatttttgttttcacagtcattttaaataga

SEQ ID NO: 2614 - DNA, 201 bp, Homo sapiens
taaatataatgaaatgtagtggtattcttaattgtgaagataatatcacagcatggcacattttttatttacccagctgactagcctatgaggctcagtgytggcagtctagatcttgcagggaggacaaatatacataaaaccctatgtttggcttctccttctaaagctatcttgataagtaatgtctacttctgcact

SEQ ID NO: 2615 - DNA, 201 bp, Homo sapiens
attttcctgaagcaatgtgaacatgtaccctatgtttttcaccaggtctatttgagattctcaacattactatgagtagtaagtgggtgcctagttgaagwgatttttatattgtttgtattaccttttccctcagcttcttatttaaatagcttagaactgtccccggtgtgtgatgttccccttcctgtgtccatgtgt

SEQ ID NO: 2616 - DNA, 201 bp, Homo sapiens
catgcacatgttggcatatttcttggaaatttccttgctattaaacaagagggaaggtgatacattttggaactccaggtgaagatctcattacaaataawggctcaaaatgcttctttgtgctttctgatttggttaagacttatttagacctattccttcaacacattaaccaggtaattaatgactgtcagttttgaa

SEQ ID NO: 2617 - DNA, 201 bp, Homo sapiens
catttccttctatcactgaccttttcaacttaactattccaggttttattgctttttctctgctgtgttcttagatatatttattttaatcattctaatgyttagtactcatgttctattgcttggtgacccatgttgtccttgagatgaaagttaggtttggaaaatcaaggacatggtattatgtttctgatgaatctc

SEQ ID NO: 2618 - DNA, 201 bp, Homo sapiens
gttcctgtatgttgtgttttatagtccattttacttcctgaactttaatgctttcatgaccacactaaaatatttttcctgtatgttctcggtacacaggrcctgtacctctccctagtattgtgtcttggagcttgtacgtactatttatgcaataatagttaattattatttgaatttatgctaatcatcttgccttta

SEQ ID NO: 2619 - DNA, 201 bp, Homo sapiens
gtatgcatatcatgtatatcctctaattggttgttagctttccaaagaagacgttaagattcctctttcctactcattttgtacactgacggtgtccacartcataatggaagaataatttaacaatgctaattcgatatccataattccttgagataatgcataaaaagagtataggaaaagaatatttggaatacagaa

SEQ ID NO: 2620 - DNA, 201 bp, Homo sapiens
gccttccacagccatgtgggcttctgtggtgctctgagaacagtctgcccctcctctctctcctgaagagagaagatgagcttcctcttcaacagcagctyatttaaaacttttaagaagagaagaatatccctgaaatgtttcctcactataaattcttaaaaaatgcaaagacaacaccaggaagtggaatttgagaca

SEQ ID NO: 2621 - DNA, 201 bp, Homo sapiens
ttgtaatatttaatttatcctaccttttgattatagcctaaaatgaagaatgtcattaactcatttataatttataataaagtgtattataattggtcatstcattgtatatgagttccacaaaaattaataatggttattttatcatatagctctctacaacatgttataatttggaatgtttgcatttgaggaagagct

SEQ ID NO: 2622 - DNA, 201 bp, Homo sapiens
aattccattcttaatgtggcacatgccaatatacatggggcattttaatattggatttctgtaagtgatatcatgaaacattatagaaacattctgcatcmaacttgactcctgttggacttcttgtgcagatatcatctagctatgtcattctacaagcacaatgggtgcgacagcaatctcacttcttaaccagggaca

SEQ ID NO: 2623 - DNA, 201 bp, Homo sapiens
gagaaatgagtaacaataattgcatatgacattgtaatatataaatgtccttggaaattcaggtgcttcaacctcagtcaagtttttttggatccacttgycatgcacatgttggcatatttcttggaaatttccttgctattaaacaagagggaaggtgatacattttggaactccaggtgaagatctcattacaaataa

SEQ ID NO: 2624 - DNA, 201 bp, Homo sapiens
ttccagtctcaactctcttactctgtgtcataacataatttggaggaacgctgattattccacagactatgatattgatctatctggatggcaccatggtrtttactgggcctgatgagaaatgagtaacaataattgcatatgacattgtaatatataaatgtccttggaaattcaggtgcttcaacctcagtcaagttt

SEQ ID NO: 2625 - DNA, 201 bp, Homo sapiens
ctgtaaatcatcagtgggcagtagctagaacaaaatttgtggtgatagtagtgaaagtcaaaattgccttgaactgactcttggtagaattctgtacattraatagcctgccattgagggcttactgaaagagaaagatgttatgagaaactggaggaaagaaaggcttgttacgtgtcagaaagcttagcaattcttcat

SEQ ID NO: 2626 - DNA, 201 bp, Homo sapiens
ggtattaaaagaaagctgttccatgttgtgtttactgccagactgttgttcggaaacattttgtctaccaaaatgagtaacttcctttcaataaaccacawcaattctaatgtagctctttccataagcattagctatattgttttcaatattttaaagaagcataccacttggttcactgttttctctttatttattact

SEQ ID NO: 2627 - DNA, 201 bp, Homo sapiens
accttgagaaaatgatgcaggtataccttagagatttacctatagaagcgtgggaaaacccactatatcttttttcaaagacttaagcttctgttcaagarttattttctatttaaagactatagtcaccaagggaaaccaaaacctggtattaaaagaaagctgttccatgttgtgtttactgccagactgttgttcgga

SEQ ID NO: 2628 - DNA, 201 bp, Homo sapiens
cttaaagtaaaattccactggatatttcttagaatatagtaattacaaaggagaccgtagaaaccttgagaaaatgatgcaggtataccttagagatttayctatagaagcgtgggaaaacccactatatcttttttcaaagacttaagcttctgttcaagaattattttctatttaaagactatagtcaccaagggaaac

SEQ ID NO: 2629 - DNA, 201 bp, Homo sapiens
tctgtatatttatttatttatttataataaattatataattccacttaaagtaaaattccactggatatttcttagaatatagtaattacaaaggagaccrtagaaaccttgagaaaatgatgcaggtataccttagagatttacctatagaagcgtgggaaaacccactatatcttttttcaaagacttaagcttctgtt

SEQ ID NO: 2630 - DNA, 201 bp, Homo sapiens
tcctgggtagctgggactaaaggtgcttgcctccatgcctggctaactttttgtatttttagtagagacaggctttcagagtgttagccaggatggtccarttaaatgtttaatgtttcctggtattctatttttttaaaaaaaattattccttttctctgttttaccatttattttttctatagagatatatgtcaataa

SEQ ID NO: 2631 - DNA, 201 bp, Homo sapiens
atagcctaaattttagaaatgtggttatagaagaaaagagatcttaacatttttgagatatcttcaagaaaactttgtgatttattgacttgggagtatayagtaagatagcatcaaggatgagtctaacaaattgttagttactagtcaaaagctgttgccattctaactcagagaaacaagagcatattttggaaggca

SEQ ID NO: 2632 - DNA, 201 bp, Homo sapiens
atgccaaacattgctcaaactcctgacctgatacaatgatacatagcatagagagaagtgtctctgaacttcataactacataactcgtgtccaagaatayacataaagaaatatatatgctgtgatctagggatttaaatgacatttggtagaaaagaaagtggctttgtgtttgcatccgaaagtctgctttagtggta

SEQ ID NO: 2633 - DNA, 201 bp, Homo sapiens
ttactgtacgaccagtatgccaaacattgctcaaactcctgacctgatacaatgatacatagcatagagagaagtgtctctgaacttcataactacataamtcgtgtccaagaatacacataaagaaatatatatgctgtgatctagggatttaaatgacatttggtagaaaagaaagtggctttgtgtttgcatccgaaa

SEQ ID NO: 2634 - DNA, 201 bp, Homo sapiens
tttctgacagataaagccattttactttgctacaaaggatatagactacaataactgacaatcataaatatatacggcaaatgtccttgctctattatacrtatattaaacctacttaaagataagcaaagtaaaacttcagtaaatcgtggtctgatttgggtatgcagacaataaaatacttgaggcacagagtttaca

SEQ ID NO: 2635 - DNA, 201 bp, Homo sapiens
cccagcactagcttttcaacactagcagagctatcagccgtgtgagctgagataaccactctatgctgaaaggcttctgcattgctggaacagctctcagsatatggatatttttaactttgtcaaagcaaggctaatgtctatagtgatttttacaataatggacattcctacaaaaatagatgtgctcgtatttgcgca

SEQ ID NO: 2636 - DNA, 201 bp, Homo sapiens
tatcataatctggaaatacttttaaattaacatgtattatttctaaatatgcatttatgtactgatatagagatagctagctgttcaatcagctcttttgyattttaaagaaaaaattatttaataagtaaaggcaaaatattttgttttttttttatgagaaagaaggaatgacaataaatataatgaaatgtagtggta

SEQ ID NO: 2637 - DNA, 201 bp, Homo sapiens
atgacaactcattttttaagatgtttttacacacttgggaacaaaatttcagctgtcttttaaaagtttcaaatgttaggagataaaaatagtgtccctgracataagtgacagacagctggctgataatgtgatgatgaatcatttgacattcttttatatttcttccttcagaactcttaataagaatgcgtgccatta

SEQ ID NO: 2638 - DNA, 201 bp, Homo sapiens
aaaacagactatatcctgtgaaagattttacacttttcaaaaatacattaaatacatggtcccatttaatcttttaaaaaatgcttagcaagcagcaattycacgatggtcaaattcctaatatgagagaagtagaaataggaaaaataggtcaccctgatacttatgttttcattttgcttaatatacgtttgtatattt

SEQ ID NO: 2639 - DNA, 201 bp, Homo sapiens
atgattgaaaaactgcctatcaggtactgtgaccattacctgggtaatgaaatatctatatacctaatccctgtgaaatgcaatttacccatgtgacaaayctgcatgggaaccccctggaccaaaaataaagattggaggagaaaacaaaaaaagcagatgtatcatgagattgtatttacttttgttaagtgtaaacac

SEQ ID NO: 2640 - DNA, 201 bp, Homo sapiens
actttatcatccataagaagcaaatattcattgattcttcaaatattatcaagagactggagcaaggcagtcacaacttcaggatccatttttaattccamttctctgtttattttcattacatctgcagttacttcctccactgaagttctgaaccattcaaattcatccttaagggttgaaattaacttcattcaagct

SEQ ID NO: 2641 - DNA, 201 bp, Homo sapiens
gaaacttaattatttactgtagatttttctaatataaacataatggagtaaatatttttctcagcaataccgtagttataaaccacaaatctggcaacttmaatatttattttcattcactgttctttttaaatatattcaaaacttcctcttggaccaacagtttattaagaagtgtggattgtttggtctgtcattaat

SEQ ID NO: 2642 - DNA, 201 bp, Homo sapiens
tagaaaagaaagtggctttgtgtttgcatccgaaagtctgctttagtggtagaagataaggagaatttaactaggtgaatctagaatattagaaaaagatrgtaggagagtaaaaaggggatggttaataagtacaaaaatacagttagatagaataaataaggtctcatatttggtagcacgatggtgtgattgtaatga

SEQ ID NO: 2643 - DNA, 201 bp, Homo sapiens
tgatttactgtatgtttttaaaataactagaagagtgaaattagaatgttctgagcacaaaaaaatgataaatgcttaaggtgatggataacccaattacyctgattttgtcattacaccttctatgcctatatcaaaacatcacgtgtgccatacatatgtacaactattatatatacccataatagttattaataaaaa

SEQ ID NO: 2644 - DNA, 201 bp, Homo sapiens
agttttaatactaatgacttaccccttctttaccattcctgtgatcctctgcttccttattcaaatgttcaaacatcacgtttttatcatgatttttgacrctatgcttttttatcctttttaatatcattttatccatgtttaacatgataatatttaattttatatttgaaatttgatgagtgtttttaaattcataat

SEQ ID NO: 2645 - DNA, 201 bp, Homo sapiens
tttattttttctatagagatatatgtcaataattaatgctgttatatataaatagattaatgtttcatctgaaaagaaaacaacttttatcattttcaaamttgttaatataataggttatttcactgacagtatcaaataactttccctttgaaaggtaaaggcatacttaaaattcatatttattcctctattttatca

SEQ ID NO: 2646 - DNA, 201 bp, Homo sapiens
atgttctgagcacaaaaaaatgataaatgcttaaggtgatggataacccaattactctgattttgtcattacaccttctatgcctatatcaaaacatcacrtgtgccatacatatgtacaactattatatatacccataatagttattaataaaaatacaaaaataaaaaagaaggaacatcatatatgacaacccagagg

SEQ ID NO: 2647 - DNA, 201 bp, Homo sapiens
tgtcttccatgatgtctaccaatcataagccagatgacagtcaagaatagctgttagtacttgtttatttatcaacatcaaaaaatgccagcaaaacaaamaacattcagaatggatacgagcagctgtggatgctgtgtggagttggtgggagtggggtgaagaggagaaaaagagagagaaagaaattagtttctagtt

SEQ ID NO: 2648 - DNA, 201 bp, Homo sapiens
cactggcagcccagggttaggatggacgctgctagagtgtcctaccccaaaatgttgctggctctgtgcaccatttccccatcttccgtgggcctgcactmatgtcctagagatgaaagaaagtgggcctacctaaccactatcccccttgctactgtgcctcttcctccttcaaggaggatgcccaaggatgggtgggca

SEQ ID NO: 2649 - DNA, 201 bp, Homo sapiens
ctatttgcatcatatgctttctactaaatattctttgcaattcacaccttcatcatctgaaaagctgtcttcattttaccaaactgtgattagcaattacwttaaatccatagttgtttcataaaaaatggcttaacgttcccatttttgtcattgccttttttgtttgttgtactttatagttaatatgttggaattgaa

SEQ ID NO: 2650 - DNA, 201 bp, Homo sapiens
ttcacaatgtctgaaaccaccagaattataagagaaaagatgaattcagtagaagataatgcactttgaatccccaatttttaatatcctttatgactagstgtagacggctgttattgacatattatatctcttttacccatgcatattttagtccttagttgaggctatgattttcctttctccttctggcatcctgag

SEQ ID NO: 2651 - DNA, 201 bp, Homo sapiens
aatctaaatatttgaatgggtagaaccagttggtagctcacttattacactgtgtatatcatagtcttgatccagtcatgattttttctaatttctgaacrttcattcatattaacaaatacattgtgaaaactaaaattgtttatgattctcaattgtaagacaaaatatttctgagagaaaaagtttttaggtataaat

SEQ ID NO: 2652 - DNA, 201 bp, Homo sapiens
caggaatatggtgctactttcacggcagcaaagatttggatgcaatcctattggagctaacgtcgtgaaaacagtgtctggtaagtatacacctattcatmaattgtcaataacctatatctatttacctgatttagttttgtgagtggaaaagttgaaaaaattgaagattttagagtataaggcttgaagttttgtttt

SEQ ID NO: 2653 - DNA, 201 bp, Homo sapiens
atgcattgtaattgcttatgtagctttcaaaaatggataatagttatatggcataacaattacaaaatctagaatgtatcaaactattattattgaatatytgtcgaatgtgaagtgagttttgaaatacattaaccacataaatctaataaaaataagttagcaaaatctaatatgtggtacagtgactgctttgtaaaa

SEQ ID NO: 2654 - DNA, 201 bp, Homo sapiens
tgggccttccaaagttctgggattacaggcatgaggcaccatgccccgccttgccaactttttaataggattatttgttttttgcttgttgacttctttasgttccttataaattctggattagatctttgttggatgcatatgttttcttccatttctctgggttgtctgtttacactattaatagtttcttttgctgtg

SEQ ID NO: 2655 - DNA, 201 bp, Homo sapiens
agttttgttttacttggtcattagttttctatgttaggctgagattacacatattaggaatatatgtattcaaatacagctattgtgattcagcaactctyaacaacagaataaacagaatcagattcttaattacaaaaactcagtgagtttaagtgattaaagatattgtggagtagtcattgaatatgctgttatata

SEQ ID NO: 2656 - DNA, 201 bp, Homo sapiens
caatttgggcaaagtaattaagtaagagattaaaaactgccactcctgaatcctttaagtttttaatggtgattcttacttttattggcagtttccccagsaatatggtgctactttcacggcagcaaagatttggatgcaatcctattggagctaacgtcgtgaaaacagtgtctggtaagtatacacctattcataaat

SEQ ID NO: 2657 - DNA, 201 bp, Homo sapiens
aagtgtcataaccttattcacacacaggcaaccttaatctactagaggtctttcatgtgtcttagcaaaactatatctttcaggactttcttggaatgtayggctggcctttggagagggggtgaataagtaatatatattcatatacatatagagagaaatatatatatataaacttcaatagttttgggataacagaac

SEQ ID NO: 2658 - DNA, 201 bp, Homo sapiens
gtatgtctattccaagccacatccccatctccttaaactgtgcatttctatgtatgtcatgcctgccatcacctgcttttaaatcgattcctttcagttcyttgtcagtgtcatcatgtctgttttcattatttttcctttcgggggccttcttgttgcaatggttaaaactttgctatttttcttcttttctacagtctt

SEQ ID NO: 2659 - DNA, 201 bp, Homo sapiens
gctttaatgtgattatcgaaattcaaaaatgttatcaaggaccaattattctttttgctgcaatttttacagatatgcaaaacttgaggttgattactgtyaaagttttagttttagaattccagagagtagaagttgtggctaaatatttcctatacacaatgaacatgaaaaagcccatcttgttttccattaatatct

SEQ ID NO: 2660 - DNA, 201 bp, Homo sapiens
catacctgacttttctttggcatgcaaagaacgtggaaggacccagattcctatatacctcccataaaataagtgtgttcagatgctaagcagagcaaaasgagcagtgagtcattaacatcaaccatcttcatcagcctgacacctacattcctcctattcaattgttatttgagagtcctacttcttaaaaggtagaag

SEQ ID NO: 2661 - DNA, 201 bp, Homo sapiens
atggtttcctctatttcagattcagcaacagtgtgtaaaatcctcacacgtggaatcgctgacttgactttctggctcatgcctgaggccaccagactgakaaagttctctgtctctcagggcttatgtgattagatttaggctgatctgaatggataatctaggattatctccatatttaaaggtccatatcttcaatta

SEQ ID NO: 2662 - DNA, 201 bp, Homo sapiens
actggttccatattttcatgtaatttttacatttatatagcagtttccctcatttttcaaaagacagtatgggttgttgcagctgcctaaccattcagttktatgtttttatgacattttattaggtattgaatttgttcaccattctgttgttgtttactctcatattttgactggatttatgaaagctgaaatcctgtc

SEQ ID NO: 2663 - DNA, 201 bp, Homo sapiens
ttaaatttgtagtaaattatataaattaaaatatgcaaattatgtttattgtcaaattatcattcaagataattattcaagtaattatttccaataaacayttttgtctctttaaggatttatttgttccatgggaaatgattaactaatagcctcagtgaaggtaatatttctttgggtaatatatgtgtcttctcttct

SEQ ID NO: 2664 - DNA, 201 bp, Homo sapiens
aatagagttctgtgccaatgcactgatcccacacctatgaagccatccctgatggctatctcaaatgcatcatgtgaaagcaacaggaatgctctttgcartgaaagtcagctggactctatgtattgatcaatatagtcaatttctcaaaagtacatttaagattctaggccgggggcagtggctcacgcctgtaatccc

SEQ ID NO: 2665 - DNA, 201 bp, Homo sapiens
atctacctcaaattttcagtgttgaaatctaatcccaaggtaatagtattaagatgtaaaggcattggggagtgactaggtcatgggattaggactcttayaatgggaatagtgcacttatagacaccagagagctaattcaccccttcgcattgtgaagacacagctaccaaatactgtctatgaatcagaaattcctca

SEQ ID NO: 2666 - DNA, 201 bp, Homo sapiens
gtgcacaatatgatgttttgacatatatctacattgtgaaataagtgaatctagctaattaacatatacattatctcacagttttcagttttttgatgagwacattttacatctctcagcattttcaagaatgcaatatattaaatatgatggattgcttaaagtaattcctcttatctaaataaacctattcatatgtaa

SEQ ID NO: 2667 - DNA, 201 bp, Homo sapiens
aatttaaatccccaacaacagtgtataagcattccctttagtctgcagcctcgccagcatctgttgttttgtgactttttaatcacagccattctgattgrtgtgaggtgttacctcattgtggttttgatttgcatttctcttatgattagtgatgctgaaagtattttttaatgtttgttggccatttttatgtcttct

SEQ ID NO: 2668 - DNA, 201 bp, Homo sapiens
aatatcaacactgtcctataaggtcagtagtagtagtttccaattaagagagagttgttctcattaaatgtatatcatggcatgtttatatctcctgtctyctagaaatgtattgtttttcctttaacatttaaaactatattccacatggaatatttttgtatgatttaatggggtccaattttttgcttttcttttctc

SEQ ID NO: 2669 - DNA, 201 bp, Homo sapiens
gaggtctgatacgtagtaaaaaccaaagagcttgtagatgagaagcaataacaacaaatgaaaagagacatactgatgttcattaactcagaaaactgtgygacctaagatattggtcaatagaaatgttcacggcaagttttgcaacagatggactctccgtctaaccgtgattgtcatcattccacaaccacacacatg

SEQ ID NO: 2670 - DNA, 201 bp, Homo sapiens
tgtcttcattctggaagttggctgtgtaaccccttcactcctgtgtaaaatggtcatctttgctgaggaattgctctctgaagatatgtcacaaccaatcyttacttgttatagatacaattagatatacaataattatggataaacataatggatacaattatgctgtgccattacttactctttctcagtcccttgcag

SEQ ID NO: 2671 - DNA, 201 bp, Homo sapiens
ttcaacatggatttaaagagcaaatttagtctaataataaatactaaactgactagacaattggacttcatgaatacctaaagttccaaatcttagaatgkgatgcagaaaaatacttgtttctcagataggaagttccagcctactctatgacaatgtcttcattctggaagttggctgtgtaaccccttcactcctgtg

SEQ ID NO: 2672 - DNA, 201 bp, Homo sapiens
gccactagtcagagcatgaccccatggaacctgcccctgcctgctctaaagccaccaagtagagctcccccaggaaacttgcttgggtaacatgctggacyccaagaaaggccttgatccacaggcctcttgctcaaacttgctcttctctctcacacacacttcttacctgctggttgagcacacctgtcctgtctgact

SEQ ID NO: 2673 - DNA, 201 bp, Homo sapiens
accacaatctatgcatgtaattatcatgaatccttataattttatgttgttttgtcatccactttgaatatagattaacttttttgtaccacaagtagggwtcagtcaaccttgacatagtttccagttttttgtctcctcccaattcctcaaggtggttgacctatatatttacctgtacaactgcctcctggtgacccc

SEQ ID NO: 2674 - DNA, 201 bp, Homo sapiens
ttctgaggaccctaactcagaaatcaagtttactcattagaaggtggcatttcagcatgtggtctgagattctctgtgagtcatctgcttcagtggtgacrcacacactgttttattaacagcatcaagacatgaaaagcaattgtgttttttagaggctctttctattaacacagtgtaaaagactccagttttacttaa

SEQ ID NO: 2675 - DNA, 201 bp, Homo sapiens
tggtaaccttctgcttgtaacagaaggaccatgacactctctgtggcctacttggctcatgcacacagaacagtttattgaatgaactaaattacataggrggcagcataaagccactttattctttcccaaaattgtcctgtcattgatttagtctctcagcttgcttttcttacacaggataaaagatctggtttgtca

SEQ ID NO: 2676 - DNA, 201 bp, Homo sapiens
tgtgaaaccatttttttctcctgaacctcttggcctgtgacgggagaggtttctgtgaaggtctctgatgtgccctggagacattttccccatagtcttgkcatttaacattctgcttcacattatttatgcaaatttctgcagccagcttgagtttctcccgagaaaatggaattgtctcttctatcacattgtcaggct

SEQ ID NO: 2677 - DNA, 201 bp, Homo sapiens
ttccccatagtcttggcatttaacattctgcttcacattatttatgcaaatttctgcagccagcttgagtttctcccgagaaaatggaattgtctcttctrtcacattgtcaggctgcaaattttacaaagtatttatgctccgtttcccttttaagattggatgcctttaacagcacccaagtcacatcttgaatgcttt

SEQ ID NO: 2678 - DNA, 201 bp, Homo sapiens
tgtgtcctctctccctctctccattccccctccctcaaaactaaagtaaaaggaatgttaactgcccatttttctgtggccagcagaccttatctctactmccaattccaattccttgtaaatatactttgtaaagtcctgtgagatcctgtctcctttgccatgccgctgcaaggtcataaagtaaatataacctaagtt

SEQ ID NO: 2679 - DNA, 201 bp, Homo sapiens
aagcaagaaccttgccgttacactgggttctttttgtgtgtcctggaagaatgacgtacacagacaagtggagggtgaacaagatgaaaggagctatactragtgatagaacagcttagagaagaccagcagtgggtagctcctctttgtaggcagggtgtcccaacaagtgttcagctctcagcagagagggtagctcct

SEQ ID NO: 2680 - DNA, 201 bp, Homo sapiens
tagtcagcagagagggtagctcctctctgagggcaggtcatccgatcaattcttcagctctcagcagagagggtagctcctctctgcagctggtcatttcwtcttctcttcagtgagcagagagggtagctcctctctgagggcaggtcatcccaccaactcttcagctctcagtagagagggtagctcctctctacagct

SEQ ID NO: 2681 - DNA, 201 bp, Homo sapiens
atcctaaatatatatgcattcaacacagaagcacccagattcatgaagcaagttctcagggacatatgaagaaacttagactccctaacaataacagtggragaattcaacacctcattgacagtattagacagatcatcaagacagaaaattaacaaagatattcaggacttgaactgaaatttgatcaaatggacctaa

SEQ ID NO: 2682 - DNA, 201 bp, Homo sapiens
aactttttaagttttcttattatgctttctttttaatgtatagtttgagcttcttttttggtttattcgttggcttgggaatttttattttaaaaatataycttacagcagaattcttagacagtttgcttcatattttaagcaatatttcaactttaaaaatatagtttaaactattaaatgtttaaaaaatactcactg

SEQ ID NO: 2683 - DNA, 201 bp, Homo sapiens
attagcctcacaaaagaaagatatcttggcatatgctacaacatggaagaaccttgagatcacaaaaaaactaataatgaatgattccatttatatgatgyatgtaaggtaatcaaaccagaaaaacagaaaatagaatagaggttgctaggagatggggttggaggaaacagggatttgttcaatgggtacatattttcg

SEQ ID NO: 2684 - DNA, 201 bp, Homo sapiens
tggcctctctcacagaatggagggaggaaaatgaagcatgcatctagaattttgggttttctgatagcttctcaaggaactgaaatgtgtgttgcctgatytaggaaaatgatggagaacttgcataatttataagcctcagagtcactgagaagaaaggagagaggtatgccttacactgtagcaccagagagcctgacg

SEQ ID NO: 2685 - DNA, 201 bp, Homo sapiens
agtgtctaaacatttcaatttgaatgcattattaaaaacataatgacagagttccttacacaatttttatttaacaactaaaagggtgattctaggttacygtaattaagctcctcaaagccttcatttataaagatccttccagagttaccattttattaaagccaaagaaaaattacattgatacttgaagcattttca

SEQ ID NO: 2686 - DNA, 201 bp, Homo sapiens
acagatgcaaatcaggattcacagaaaggcttgggggattttgtgtgtgccagaggacaaaacaataaagaaagaataggcaggagctatgaattttgaayacaaacgtgctccttcagtatatgaactaaattttggaaacagtaaaagaaattcagctggctttaaggcatttgtttttttgttttcagcaaacaataa

SEQ ID NO: 2687 - DNA, 201 bp, Homo sapiens
catataagcattttatatgcagactgaaaatatattgcacatgtgacatgggaaatcaaatttggggttgttggaatgagggataacaaattgtatgaaayaggatgaatgtgattgtaattatttgtgtccgtctgttctcacactgctataaagataccatctgagactgggtcattcataaacaaaggaggtttaatt

SEQ ID NO: 2688 - DNA, 201 bp, Homo sapiens
tgaaggttagaactacgtgtcccctcagcattcacaatcacatttttatttttattttggcttctgagaatctttacttttgggctctaagaatttttatktatctatttgccaggtgttttctctctctctctgtctttcacttttcttccatccctcccttcttctcttttcctgtcttcatcgctacatctgtcatca

SEQ ID NO: 2689 - DNA, 201 bp, Homo sapiens
aatggggtttttgttctgtaaattgaatcaaagcatttacaaaatagtgttttcatactcgtattgatggatgtgaatgaattctctatcattgttgctaytgtaccacagtagagaaatccaaacagacaggtacaattttctctaagaacaagatcaatttcactttttggtagtttctaaattgtgtttgtcaattgt

SEQ ID NO: 2690 - DNA, 201 bp, Homo sapiens
ttaatatcatcacattgagcaataacgtttcaacataagaatttcggtaggacacaagcactcagtccataagagtaattaaaaattacatttcaagggtmcttgttcactgataagatgaagcattcttttgtaaaaatagtgaaattcagtaacaccatccagcataatgggagacgtattaaaatattgtggtcatta

SEQ ID NO: 2691 - DNA, 201 bp, Homo sapiens
tcgttgtccactttcaaaagcagagcctgatccattctaggattgctcctggatatgtctgtcactttcctggctgaaatttagtttctatctattttttmtctctggctacagttctttccaaagaaactttcctggagctaattttcgctttctgttgcatcccatacacatcaatgtatctgggtgaatatcatccat

SEQ ID NO: 2692 - DNA, 201 bp, Homo sapiens
gacccattgtctgtcatgcttcaaaactctgaatattctgagttttcaatcgttagttaactctacagactaatattttcattcctgagcaatctctgcayttttcgttgtccactttcaaaagcagagcctgatccattctaggattgctcctggatatgtctgtcactttcctggctgaaatttagtttctatctattt

SEQ ID NO: 2693 - DNA, 201 bp, Homo sapiens
gattaagaattttaatacatcctttgtaaggaagtattttttagcttacattatattctatagatctcattacatcacttaaaatattggtttatagttcytttgcttttaaaggaatataaatacatatctatattttatgaaattattaatttaaatatatacatatatcatgatgaatgtgtgatacggtaatagtac

SEQ ID NO: 2694 - DNA, 201 bp, Homo sapiens
aaccatatttaagccataacacttaagattaccattgttttataaatagataaagtgagttgagttgtatttgacagattctactcaagccctgaataaasacaaagaatttattgggtacatttaacataaaaacctaaattacgtaacactttgtagttttttcttcataaaatgctgcatctaatttctttctttagc

SEQ ID NO: 2695 - DNA, 201 bp, Homo sapiens
agactttccctctcttttctttgtgacagctctgcagcaagaaggttttgtaagaagctgcctttgtcaagacacaataggtcctttttttaccctgaccstgtataaatgtgcttcctggcataatatttgcatgaataaaagggaataatcatatgacttcttagcagaacaaagatgatgtgctccaaggtgactttc

SEQ ID NO: 2696 - DNA, 201 bp, Homo sapiens
tcagggggtgactgggcctggccccaccaaagtggcttccagaggtgtgttcccagggcagcaggccctagggagaagctccggggactacctgccttggkgtctgaatctgaggacttatatcctgggcctgtaccccactgcagctggcatcatggcagcagctgcttcagaggggctgccactgccatcattaacact

SEQ ID NO: 2697 - DNA, 201 bp, Homo sapiens
atttcataacttgttattggtctatttgaagaaagggccttgaataaaattcaacaccccttcatgctaaaaactctcaataaactaggtatcgatgaaaygtatctcagaataataagtgctattcatgacaaacccacaaccaatatcatactgaatgggcaagagctggaagcattccctttgaaaatcagcacaaga

SEQ ID NO: 2698 - DNA, 201 bp, Homo sapiens
ttaccatcctgtaatatattaatggaccaattcacttaacaaaatgaagtttcttgggaatattttacaggaccaggagaccaagagtcacaaatttttaygagaacgatgaaccagtatgaaaagatatataggaagggagattgcttttcaaatcttttgatttgctacaactttaaacttacatggtcattgcaagaa

SEQ ID NO: 2699 - DNA, 201 bp, Homo sapiens
atacatttacctttattaatattattatcattactgattatttctatgtgtgttactctacaccagataaaaattttaaatctaagtgaggtataatatargttctttcattaaattattataaaacgtattttggaaccaaaatatttataaatagattagaatacagacacatacatatatatgtacatgtatacatat

SEQ ID NO: 2700 - DNA, 201 bp, Homo sapiens
tagtcaagcgtctaatcaatggcatctctttaggtctaagggtctccaagtttattacacataagagttgcttgagaagcttgttagtgatgcagattgcyaagacccactccaagaattttgcttcatttaatgggtttggagggtgcagtaagagatattataacaacttccaaagtgacttttttgtggactatgctt

SEQ ID NO: 2701 - DNA, 201 bp, Homo sapiens
tttagcaatcattgccagtcatgatcattctggggctttcagagtcatgaccattaaggccgtgaacacaatgaccgaaagcaagagagaagaaagttagkgacagctatataggagtgatatgagtagtgccttcaaagtctcaaattctaaactgatacagatataatataaataaacaagaaaggccacattaaaata

SEQ ID NO: 2702 - DNA, 201 bp, Homo sapiens
attatgtctgaactagtttttttaagaacaaatgtaatatctatactttaaatgcaagaaaatacatatctatcaatgatccagcaattccacttcacagrtattttgctggcataggcaaacatttgaccacaaggtaatcatacaagaacattcataatagatattcataatagcccaaatctggatgcaaatgttcac

SEQ ID NO: 2703 - DNA, 201 bp, Homo sapiens
atactttgaagagaagcattctataccctttggtgaacaattcatactcataactcagttcctacagaaactgatatattcacaatgccagaagttcccayttacattgcaaaggcagacaagctgacctattattttaaggtttgagggttgttgcagaaggactctattttcttaaaagtattttccttttatattgaa

SEQ ID NO: 2704 - DNA, 201 bp, Homo sapiens
gttgatacgtttcaataatatagaccctgaaaaacactaacagtagcatttagcttatttaaagtcaaacagaaacagaagaaccataaattcacaacagraaggtttcagctattaaagaaaaatttacaacaaatgcacttagaatcactatctaaggagtcagtaaaggaagagagacagagacagaagacacacaca

SEQ ID NO: 2705 - DNA, 201 bp, Homo sapiens
ggtttgtagttctccttgaagaggtccttcacttctcttgttagctgcattcacaggtattttattctcttagtagcaactgtgaatgagagtttgtttayaatttggctctctgcatgcctgttgttggtgtataggaatgctagttatttcttcacattgattttgaatcctgagacttttctgaagttgcttttcagc

SEQ ID NO: 2706 - DNA, 201 bp, Homo sapiens
atcatgatgaatgtgtgatacggtaatagtacatattgttttctataatgttgctttatatgtgagatgttaacacttctcttttcacaattatctacctsccatatttgcaaaaatggctgcccaatattgcaactaaagcatgaaaaatattattgtcactttttaaaaaaaatagggatcctgtcttatacaatttca

SEQ ID NO: 2707 - DNA, 201 bp, Homo sapiens
taccataccaaataaaataaaaatctatctcaagggcaatgctaagagaggtttttctttccatatgtcatcgaagaagattgctaattgacttttcaacmtatcctcctaatctagggtaggcaaactgtgtcccactgaccaaatctgatgacctttcacctgttttgtgagttaagaatttttgttgtttatgttttt

SEQ ID NO: 2708 - DNA, 201 bp, Homo sapiens
gtataatgatgaggagagagcagagggccccttgggaggaagtaacagatcatatatgatagtttgaggttatgtctttgagtgaggtgaatagatggggrgaggagaaataagggcgaaggagcaggtacagggggtgcgcaccgatatggaaggattggtgaagagatgtcacaatttccttggtttgctcttgggcga

SEQ ID NO: 2709 - DNA, 201 bp, Homo sapiens
attttatctagatagattccaaactcagagcacctgtgttcttcttacccattcagttcattacagctcctctttttttatgtgctgtgaaaagctaatamaatttagttagtttttggctctggttatttatagatcatcatttcatgcaaattcttctgcgacaacaatcattatcattctcaccataaactttttaaa

SEQ ID NO: 2710 - DNA, 201 bp, Homo sapiens
tcaagtcaaataaggtgaaggtgctaattaaaggaaaaacaaaattttatgtatccttgtgtatcattgggtaccacaggatcctagtggtaatttgcaaytgtatcatattgtataattataaacatataaatagaaataactttcttaaactcaagttcttatggcaataaaacatcctgcttgtttacaaaaatatat

SEQ ID NO: 2711 - DNA, 201 bp, Homo sapiens
agagagtggcgatcttggcggagataaactaagcacatatcaaacaagaaccacaaggtaatctgccagcataaaaagtgtcttgtgaaaaaaaacaccgsgttacaggcattggattatctgtcaggataaagatgtatccgtggaaggcacaccataaatatcaagcaccaattcccttggaattctatcacggtaggg

SEQ ID NO: 2712 - DNA, 201 bp, Homo sapiens
cccttctaagcagaggaagagaccagagtgcttgtatactggctcattcgatctcagtccccaccgccacctgcctcctgctctctctctctttaccaagygagggcacaacaagaaggaagtcccctacaagttagaaagccctcaccaggaacaaaatctaccaaaaccttgacgttggactccccagtccccaaaatt

SEQ ID NO: 2713 - DNA, 201 bp, Homo sapiens
tgcttccaggattatgtgcagaatcacatatggtatttagctgtcatatcttttaagcatctattaatctggaacatttccacagatttaatttctgtttyttaaccttgacattgttaaaaagtacaggccagttatcttttgcaatttctctaaattgaccttttctgatatttcctaaagattagattcatgttatgc

SEQ ID NO: 2714 - DNA, 201 bp, Homo sapiens
ttgaatgaaatctgaaagaaaaacatatttttacaatttatgtaacagaatattttttaaagactgaaggtaagagatttgacttccagaaaaaaatacaygatgtaaatacacatagttgatctagtgttttgtataccaaaggaaaccaggctaatatcttgggcagcaatacaaaaataaaccattagccaaaccagt

SEQ ID NO: 2715 - DNA, 201 bp, Homo sapiens
cagttaaggatgcagattccggatgcacaatgttttgatttgcatcaagaatctgccacttactacctggataatcataaacaatttacttccttctccaktcttcaactcccgttcatcatttgtaaaataaaggtaatataattcccaccggttttgaaagttttatgagtaagtgcgtatggtattttctcaatgttt

SEQ ID NO: 2716 - DNA, 201 bp, Homo sapiens
tatgtaaaatggtaaagcaaaattacataaaattcaaactttttgcttaagccacaaaatgctattattcctattttttttcaatttactctctacccagwctcagccaattttcatcaaagaactatggatcttcagctgactgtgttgcaccttcacccaataatctcatcccacgtctcaggaaatagtggcgttaaa

SEQ ID NO: 2717 - DNA, 201 bp, Homo sapiens
ttttttgcttttcttttctcacttctttttcctcacattctatcatttctcacactctcttcttcttctttatctctcaccctaaccctctctcttacctrtgtgcatttaattgacttggcagcatttattttattttaatttttaatttttacaggtacatagtaggtgtatatatttatcgattgcatgagatatttt

SEQ ID NO: 2718 - DNA, 201 bp, Homo sapiens
ttttgaataagaagtaattttcacttatcagtctaacatgtatctcaactgatatttggtctattatgacttgcaattactctgttattgtttctcatacrctccaactctaaaatcctcctagatttgttttctcatataaaatatagtttttgttatcacccatgcaaatgttacttacattccaacagtctcatgatt

SEQ ID NO: 2719 - DNA, 201 bp, Homo sapiens
ttaataattgtttttcatcacttcttccttgtgctatgggtattatgggatttttgtttgatttttgtaatgtagatactttcattttatggcatatggaraaaaatcaggcatgaccattatccatatcaattatgatactgggaaatcagtattagcaaaggaaaatgtgcatggtatgtgtgtgtgtttatgtttgtg

SEQ ID NO: 2720 - DNA, 201 bp, Homo sapiens
tgaatattatgtaacccacttttgaaaaacaaatgaataatggaagaaatcaaatgaaattagaaaatatcttgaaacaaatgaaaatggaatcacagcayatcaaaactcatgcaatgacgcaaaatcagaactataagggaaatacacaatactagtcaccttcatttaaaaaagaagaaatatctcatatcatagaaa

SEQ ID NO: 2721 - DNA, 201 bp, Homo sapiens
gaagaatggtttgcatattcattatagaaagtttctgaaagacttatgactcctcaacagaaagtatcaacaatttgggggctaagttgctataaattccwcctcttaaaatccttttcatacattcccaacaatcctatgttggttttattagctttaccaaatccaatcaagtcctctccttgaaccaccctcctttaa

SEQ ID NO: 2722 - DNA, 201 bp, Homo sapiens
tgaggagcagaatgttaatcaccacaacaatggggagcatgtctccagggcatgtaagacaccttcatgacaagtcctcttaccataggcccagagtcttrggatggaataatggttttgtggaacagggccaggcccccctgctctgtgcagcctcaggacatgggtgccctgcatcccagctactttagctgaagccat

SEQ ID NO: 2723 - DNA, 201 bp, Homo sapiens
tgtgaagaatcccatgtttgcttccccttctgccatgattgtaagtttcctgaggcctccccaggcatgctgaactgtgagtcaattaaaattctttcttytataaatgagtcagtctttggtatgtcattacagcaggatgagaacagactaatataaaacccctgcagtaacctctgtttttcaagggttaattatatc

SEQ ID NO: 2724 - DNA, 201 bp, Homo sapiens
ctatgcatctctttcttgactaattgggtgtttgtctaatatttcatggtaggaactgagctgctgagcctggtgaaactagtagttccagttatgaattygcatgctttatgatgcatttttcgctacacacatcactcacctgaaaaaaatgcataaattgtcatatgctattttaaaccaagttctgctggctacaat

SEQ ID NO: 2725 - DNA, 201 bp, Homo sapiens
tttttcttttcacttaactacatttttatcacaaaatgtaggatatttatgtatgcatatgtgttttataaggaagacctatgtaatcagatttctagggwtctatttgaatgaaggatcaaagtgcctctgggaaatatcttttcaatgaaacagcaattttttgtttcaaggcacgacatatttcactatgaaaaaaac

SEQ ID NO: 2726 - DNA, 201 bp, Homo sapiens
aatatcttttcaatgaaacagcaattttttgtttcaaggcacgacatatttcactatgaaaaaaacatagccaaaacatgggatttataaccaacaatacrctggagaaaaacgcacaaaacacaaagctaatttcgtattaaactagttgggagaataaggcctagaaatgttgactgaatgtatccttcattgtctcct

SEQ ID NO: 2727 - DNA, 201 bp, Homo sapiens
aacatgtacccagttttatagttgttaacattttatctcattctctctattcataagtttacatgtatacatatgtttgtttttcagaacctcttgagagyaccttggatgtgctggacccctttacccctaaatacttcagtttgtatgtttaaagaaaaagggaattttcttacataacaacagaaatgtaaaatgcta

SEQ ID NO: 2728 - DNA, 201 bp, Homo sapiens
agatttgacttccagaaaaaaatacacgatgtaaatacacatagttgatctagtgttttgtataccaaaggaaaccaggctaatatcttgggcagcaatayaaaaataaaccattagccaaaccagtagctcctttgacatcaagctctgattgccctggtacaaacatggaggaacatttactatgcataacactcttgc

SEQ ID NO: 2729 - DNA, 201 bp, Homo sapiens
tttttttctaatttctagacatctttatacaaatatttatattacttcttccagtttatttgaatgaaaatctctaacctgatgaaaggatggaaattcaygataaactaaaagggacaacttttgacatataataagatctgatacacatatatgtgtatgtataattattcaaaatttagatttttttaacaatactca

SEQ ID NO: 2730 - DNA, 201 bp, Homo sapiens
tctcatataaccaatgcaaaatgcgaatatagctttctaattcttagtgtaaaactttgaatttataatctttatccatgtcttaggttagactccaaatkttcttattttccccccaaaaatattcaacttatgaaacaagatcatgaggtgtcctaatttagactttgaactaaagtcaactaggtaatgattttagat

SEQ ID NO: 2731 - DNA, 201 bp, Homo sapiens
gttttacaaattaaatgcaacttgaggtcaaagcaagtgtattgtgtatacatgatgatcatttgttagaacaagtaaaatttgtttttaaagctgcctakccttgatgagtcataaacaaaattatgtggaatgtgaaaataattgaactacttagaactaacacccactcagtgataggtgattaatcctgctttaaaa

SEQ ID NO: 2732 - DNA, 201 bp, Homo sapiens
agttattaaaacagtgagaatttgacatagataacttgtttcatagataataaatagctgagaaaaagaaagagtatcaccagagcccagaagacaggacmaacatacaaaaggtagaatcacagggatctgcttgggcatctcttaggcacccagaaaaaaaggcagcaatgacaagaagaggctaaaagcaaggaaagg

SEQ ID NO: 2733 - DNA, 201 bp, Homo sapiens
taaccacatggactcttcctttcaaccataagagagatcatgaaataaagcatggagaagtgtggcaaagtacaacaaaaccaaagtgtaataatttattsatagaatgtttgaacaaaaagagctcgtttctgcttaatgttttatgtaatcccatcttttccaaatgaaaacctgaaactcaaatctataatctgatct

SEQ ID NO: 2734 - DNA, 201 bp, Homo sapiens
gaactgtactgttcatcacatgtgtgagtctgttagataaactgtattctcaaatgcaataatgacaaacacaaaaatagaacattttagcttaaaatacyaataaaatatttattatatatggaagtaatttagttttcactttttacactatgtattttataattataatgtaggatattaaatgatggtaaattaaca

SEQ ID NO: 2735 - DNA, 201 bp, Homo sapiens
aaagattatgtgcacaagttatgaaagatcttaataaaatctttatgaaaaaaaggatttcacaagtaaactgggaaacaatgcatactatatccctgctygatgatttgcagtattctgttattaaaatctataataaatctgctgacaaaaatacacttaatagagctaacatggtattgcctatatcaattttagggc

SEQ ID NO: 2736 - DNA, 201 bp, Homo sapiens
ggattaacttgctttctatttcatcaatttttaatttaatatttactaacttttcatctttctttttttcaggcttcctttgatatattttatatatactytctttctgaaactcttacaatgtatgcttaatcatttacttaattaccccacatcttaaaatacatcttcaagagtacaaattttttgctgattaatgtt

SEQ ID NO: 2737 - DNA, 201 bp, Homo sapiens
attaagagtgttccgaggagtgactttaatagttaggataactaaacttttcttctttcttgagttctgagcaagtgaatagaacaacagaattaataaaytgaagataaaactgttagctttatttctggggaaagtggcatggaggatatggtttccataggtgaggcacagcatgctttctaataattcctgccttac

SEQ ID NO: 2738 - DNA, 201 bp, Homo sapiens
tgagcaagtgaatagaacaacagaattaataaactgaagataaaactgttagctttatttctggggaaagtggcatggaggatatggtttccataggtgargcacagcatgctttctaataattcctgccttactgctcagtttagattataaaacagtgcaacaggatgaaaccttaagtatgcacagtacactcgctta

SEQ ID NO: 2739 - DNA, 201 bp, Homo sapiens
tgtggagtgataaatgggatgattcaaaagaccaggactatttaaggggaggaaaatcatctacattaaaataagaaaaatagaaaaaaaatgttccccamgttcccaaataattatataacggaatttaatcaagttgtgttacaagtcagatttagtatccagaaatattttttttttcttttgcaaggtgctgcaatc

SEQ ID NO: 2740 - DNA, 201 bp, Homo sapiens
acaatgcaacttaaagaaatttttaaaacaaatgcttagacaatgtaatgttcttctacagatttcattctgacagagttgtgtttctatattttaaaaamtatgcaatgatattagctattgatatttcaaagcattgtatcctatactattgacttgtaaataatatgcctagttgcaatgtatggtgaatgagtattc

SEQ ID NO: 2741 - DNA, 201 bp, Homo sapiens
aaaagataaaagtgtgctaatccaaaatgttgataaaaattcgaacaattggaatggtaacacatttctggtcttattgtaaaatagtaaagccactgttwaaaaatgcctttgatcatttcaatagctgcagaaaaaacaatcattaaaattcagcatttcttctttacaaaaattctcaacaaactggagcacagaagg

SEQ ID NO: 2742 - DNA, 201 bp, Homo sapiens
ctaaatctaaaatacaagtaaaaatttaaaaaataacaaaaaaggaggcatagcaatatgatgtgtgcttgtggttgtatgtgtctttctgtgtgtatttrtttcctcaagcaatattcatcagctcaatccaggcacagaatcagagaggaaaaaaaaaagaaaaactaactaggtttggagttttgacagagtatgaga

SEQ ID NO: 2743 - DNA, 201 bp, Homo sapiens
ataaaaaatttcatatttctttgaatgattaattatacaaatgtattgtaatacaaagataatttattttagtcaaacataccagaaaacaagcatatggygactataaaatgtatttcagtttactgataaatatacttattgttttattattaacaatattttattgaggctaatgcactattttaatcattgccatga

SEQ ID NO: 2744 - DNA, 201 bp, Homo sapiens
aattcaacagttctgtaagtggttattgggtgtaataatgaaggaagtcacatctacttccacactttgatgcatttttgcaatggtaacaacagcaacgyacttggttgtattctgtaagaaagaaccccaccgtttcggcatgtaatctcccaacttttatcatcatcgagtcttcagtaggccaattcagttatgtta

SEQ ID NO: 2745 - DNA, 201 bp, Homo sapiens
aataaaataaaaatctatctcaagggcaatgctaagagaggtttttctttccatatgtcatcgaagaagattgctaattgacttttcaacatatcctcctratctagggtaggcaaactgtgtcccactgaccaaatctgatgacctttcacctgttttgtgagttaagaatttttgttgtttatgttttttaacattttt

SEQ ID NO: 2746 - DNA, 201 bp, Homo sapiens
gagggcaaaagagaaagtgccacatctgttttcaaacaaacagatattatgagaactcactcactatcatgggaacagcaaaggggaaatacacccccacratctaatcacattccacctggcccctccttcaacgctggaaattataatttgatattaggcttgagtggagacacaaaaccaaaccatatcattctgccc

SEQ ID NO: 2747 - DNA, 201 bp, Homo sapiens
taaaacgagggagattttttagattttttattcaattgatgaattgaatactactattaatactactactgtaaatgattggcatgacaaaaaggagcatkcaccccaggtgcaaagaagaaaacatgaaaccaaaaaagtaatttctaatacataaaaaaaaatctatgttttcatttgcctcacttcagtcaccgtatt

SEQ ID NO: 2748 - DNA, 201 bp, Homo sapiens
aattttatcatcttaaagcaacaccttttctattgttaatcgaaagaccttctgagacagtgactagctaagggcagtaacagtaaagatctgtttcagayagttagaaaagaaaatagaggtgaacacacacatacacaaatagaagcaaggaaacgatgacaagaaagaaattaatgaaacaaaaaaatgcatatgtag

SEQ ID NO: 2749 - DNA, 201 bp, Homo sapiens
aacatgacatcccagtctacctaaaagatggtggagaagatgctttggggctgggagggtcagctggaccacatgttccctgctcccgtccttgagatcgracctgtctttggggatgccattactcatggctgctacctctgccgacgtttatagctctattttcctatggcacttcaggacatagacccttttctttaa

SEQ ID NO: 2750 - DNA, 201 bp, Homo sapiens
aggggagaatcacagagtaatcactccaatgccccaaggcagtgcagaagcttatataccatcttgaggttacagaaagaatggagtttcaaagccttaaragacaaacgtcagctgaattaaaatgtaaaggagttcagctgagcaatgagtgattcgcaaatcgggcagcccccagaatcacagcagattctgagagtc

SEQ ID NO: 2751 - DNA, 201 bp, Homo sapiens
  misc_feature (101)..(101): n is a, c, g, or t
atattactgagagctgaattctagcatcttagtgatagtccttgtcgctaagttaggtgtgaagggagtgcatattctaggaagaaacagccaagctacanaccctccagcaagctccaccttccagcaagctccacccttcagcagatttccctggggggcatgactaactccaccagactcccgccacatctcaggaaa

SEQ ID NO: 2752 - DNA, 201 bp, Homo sapiens
taatttatgttattctcttccactcacgtggcagattttaattgcaattagttagctgctgtcgggtctcggcatgctgaaggctgggggaagtcctgatyggggtagaacaattaccaggacttttgagcagggctggtattagagggagcgagcgagagcacccatcaaagttgtgaatcttaattctcctggtaatag

SEQ ID NO: 2753 - DNA, 201 bp, Homo sapiens
agcttcttctctgctgtaccatggcagagaccatgtgtcctcttcatgcagggagctcctttaggcatttgtagagatctccctgccctttggtatcacaraaaacctctaagccctctatttctgtcctagaatctccaattttcccaagggggctgatagtcgtactctattttcttcaggggcatccacactccttac

SEQ ID NO: 2754 - DNA, 201 bp, Homo sapiens
gtgttgtctataacctgtcaatatttttctctcaacaatttccagctcaataagtgggcgagacaaggttatcaataacaagttggttattaaaggttacygtctattcacgtgatagctttccatttccatcattgaattaaggtctcagtttttatttagttagttttttagttttggttgaaaggggtttgtgtttat

SEQ ID NO: 2755 - DNA, 201 bp, Homo sapiens
acaagatttcttattacagctcagtaaataataaacatgtcacccccttgccccattgcttacccctgggtgacacataagagacagtgggaattttcccygtgttagtagtggacattccctaagtgagggggtaggaaaaactatttgctctgcttacaaagggaaggaggcagccactcctcttgccttctgaaaggc

SEQ ID NO: 2756 - DNA, 201 bp, Homo sapiens
aagacgttttttcctcgtaaggtgacatttacagcttccagggattaggagtaatattcttgggtggaatattttgcgtggcctttattcagcctgctctrttgcctcataggattgttgtgagaattatattaattagttcttgtaaaccttttagaacaatatgacacatgataagcctcaacaaatgtcaccagtgaa

SEQ ID NO: 2757 - DNA, 201 bp, Homo sapiens
accgctatccatttccagaactttaaaaactcttcctaagtggaaattctgtgtccctgaaataataacctcccattctcctttccccaggccctggtaasttctactttctggctttatgaatttgcttattctaggtaccttatataagtggaatcacgcagtatttgcccttttatgtctggttaatttcccttagca

SEQ ID NO: 2758 - DNA, 201 bp, Homo sapiens
taagtggaatcacgcagtatttgcccttttatgtctggttaatttcccttagcataaagttttaaaggttcattcttgttatatcatgttcctgaatttcwttcctttttaaaactgagtaatattccattgtaggtatataccacattttgtttatccattcacattacattgtatttttgttccaattcccttcaacac

SEQ ID NO: 2759 - DNA, 201 bp, Homo sapiens
ttccctaagccgtatgccctggaatggggcaaatgtttgcttaatattttagcctgtattcttaacacccaagcttaaaatcaaagagggaactctaatastatttctggcttctctgggcatggcaaatattgtgttaatcactttacttggtgtttgcaatctgtttcattgtcgctaatatgaacatgacatacaata

SEQ ID NO: 2760 - DNA, 201 bp, Homo sapiens
cagaggcttttcttcattgcctggtgattcaaaaaatgtctattgaatgaattaacaaatgaacagcttatatactggataaaagcaaaacaatcaagaakcaaatgaaaacaatgaataaaggaagctactgtagcttcctctaacactctgaaaatagctcaatctttaatggggcctcatttgaaaataaagtaccag

SEQ ID NO: 2761 - DNA, 201 bp, Homo sapiens
taggagctattttcagaccatatggaactgcataatgtattggggttgtcgccagattcaagcaaagtggttgcattttacaagctggagagtccctttcrcaagtaggattacagaataattatgctcatctttagatgtttctgagagttttcattgggtctatatatgatgatagaaaagtaggatgatgataatctt

SEQ ID NO: 2762 - DNA, 201 bp, Homo sapiens
aaaacagagcttattagaaatccagttagaattctaataaacacctgtatacataagtctagattttagccacgatgagcctggggttgcaaactttgaawtcatttgtgtataagaagcattcagttcctctaggagagaacgttgggtggagtaaatttaaaggataagcgattggaaagttaaggtattggtgcactg

SEQ ID NO: 2763 - DNA, 201 bp, Homo sapiens
ttcctctccatgtgctcctcatttgcagccacccgaatgagattgatgctctatgcctgaatgctcaggctgtacctagattctccacactctagaagaaygctctgtaactagcagttgtcttctgtgtttctaagctatcaaactgtgcaaagtcaacaaaattccactgttttgaagaattaatacagtttttagcag

SEQ ID NO: 2764 - DNA, 201 bp, Homo sapiens
ctttctttatccataaattatatctttaggtattgtgagaagcaaatcaatattatccaaagcttattgtgccaacattttttagtgaagaggtacagtaygtttttatttatactgaaacacattaaaatatgaaataacatctttaaacattttttacttatatgtacatatatttatgagttatcaaattttctaaga

SEQ ID NO: 2765 - DNA, 201 bp, Homo sapiens
aggtactaaatgcatttcaacttacaatagtttgaatttatgatgtgtaattataaggaagtaatcccatcttaaggtgataagcatctgtagatgtaaamgatattaaataatgtagccaagataatgcctttataagtgaagttgatttcaaaacctgctttttggctcagatttgtttcataacacatcactgcatta

SEQ ID NO: 2766 - DNA, 201 bp, Homo sapiens
catatacaaaaatgaaagcaaaatggatcaaagccttaaatctaaaacctgaaactatgaaacgactagtaaaaaacgttggggaaatgctccaggacgtyggtctgggtgaagacttttttgtataagacttcaaaggcagaaaagaaaaaaaaatagacaaatgggattacatcaggctaaaaaacttctgcacagcaa

SEQ ID NO: 2767 - DNA, 201 bp, Homo sapiens
gctgcaaggaccaccacctaggggtcgtgtggtgcatgtcatgtgcttggctttctgcagcagtgttggagagttccatgggaaaagcctcctctccccamccctcatcatctcctcgacccctttctcaacaaatgtcagggactaaggcttccttattttctcctcaatcaccttgcagtgcttttcactgaaggtgag

SEQ ID NO: 2768 - DNA, 201 bp, Homo sapiens
taaacttaatatttttacaagttttgaccattaatggcattattatttttgtaccacagcccaaaccgtaaaattttacatgatttcaatcagtttccccrgctcttctcacttctcagggccttcttaggggcaagcatggttctatttgtcaacctgccccatacacttacccacagaattaagcatacacttctcaga

SEQ ID NO: 2769 - DNA, 201 bp, Homo sapiens
caagatgaataaaaggcagaactatagaacgattttatagagacaattgggaatttcacttcgtaacctcatctacaataaaaaaaaacttacctatgaartattaactctgaacgaaggcttcttggtctagaaaataaaacatctggacgcagctgctcatggctatattcccaacactgggaggccaaggtgggtgaa

SEQ ID NO: 2770 - DNA, 201 bp, Homo sapiens
cattatatcttcctacagcttatcaacatcagtgtggtgttgcactatccagtaagcctagatgccatgtatgaatggtacattttttctatgtacttccyttactgcataattttgaaatgtcagattctagcacagattgtttccacttctctatccaaagaaatgacaagaaattgaattggataaatattcactata

SEQ ID NO: 2771 - DNA, 201 bp, Homo sapiens
tagattttccttgttttttggcttgttaagtgaagtgttgtgagtggagaaagaacaaagaaatctgtaactggttgtgatcaattagttgtatctatttktagtgttttagagtcctccatactatcctccatagtggctgtactagcttgcatgtccacacacagtgtataagaattcccttttctcctcattctcacc

SEQ ID NO: 2772 - DNA, 201 bp, Homo sapiens
gggtaccccttcaaagggacacctatatctttgtgacatattcccatcattctttgagcacatccttacatttttgtactatttacattttttctactttkcctgacccagccctgacatcaaccacttctccaaggagccgtgctctcccttcagtggaaaatggtatctatatccgcggagtgcttactgctactgagg

SEQ ID NO: 2773 - DNA, 201 bp, Homo sapiens
tatttaaaattatttgtctcattaatataggaagcaaaaatatgaaagaataaagactagagaggtaggaggatgaaaagatcccgatatgttatagactraatgcttatggccctccactccaaatgcatatgttgaaatctaatccccaatgtgatcatatttggaggtagagtacattttgggggtgattagcacaca

SEQ ID NO: 2774 - DNA, 201 bp, Homo sapiens
agtgcaatctccatcaaattaccaccatcattcttaacagaattagaaaaaaacaattctaaaattcatatggaactaaaaaagagcccgcatagccaaarcaggactaaggaaaaagaataaatctggagtcatcacactacctgatttcaagctatactataaggccatagtcaccaaaagagcatggtactggtatta

SEQ ID NO: 2775 - DNA, 201 bp, Homo sapiens
acaaagctttcccaggattctttgaaaatgtagggatattgagtgaatactttcctaaataagatacagaatttttcattattttcatagagcaagactastggtagtttttaaaaatatagtgtatgaaactctgcatttaaaaaaattatcttgagtatgcaattttttgataatctaatccagaaataaacaaatttc

SEQ ID NO: 2776 - DNA, 201 bp, Homo sapiens
tattatcatccttgttttaaagttaaactataaactaaattcctgccatagtcagcttggcctaaacccaggaatgagcaaagacatgtaaccttgtaacyttgcttctaactataagattagaagcaagatgaagtcagccatactaaatttctctcactgtcataatcttacaaaggtggtatcatcttacttccaata

SEQ ID NO: 2777 - DNA, 201 bp, Homo sapiens
aatggcgaaacaattcatttgctaacaaaaataagaaactccctggttctaaagaaaggtgccatcggagttgtcggaggaaacacaaagtgatctgcagycgcaggaaatggctgtggataggagctgcaatgtgaaaaagaggagggcacctggtcttatatggagggaggcaggggcataagtaccccaaattttcac

SEQ ID NO: 2778 - DNA, 201 bp, Homo sapiens
attctgacttgagaggccaatcaattttcagatagttctttgcttaatttaacattgttaaatttaatttttctacatagtttttcatttaatagtataawttcaaaaagcttacctatttttttttaatacactgttttgtgacagtaattttctgtaaatgttttgaaaggatactcttatcttctgccatttgtcatt

SEQ ID NO: 2779 - DNA, 201 bp, Homo sapiens
atctgtatcaatcagtcaattaaatgcacttacacacacatatgtgtaggtgtgaatttaaacatgtgattttaatgaaaaatcaaaattttcataaatarcaaaaactaattgaaaacgaggatggacacagtccaaatgtcctctgtcatctcggtctcattgtccaggcaccagcaatgcagaatattgacattacag

SEQ ID NO: 2780 - DNA, 201 bp, Homo sapiens
gaactaccccctgagtaatggttttcagtctatttgttccactctgacacataaacagacaacactcacatatgtacgttatccaaagtcacattgaatayccagtgaaagagtaatatgattaacagtctccaattcattcttatttaagaaagggtaaaatgttgcaatttttgatgttttatccttaggaacaaatag

SEQ ID NO: 2781 - DNA, 201 bp, Homo sapiens
ttgtgtatctaagccctcaccatctctgaccagcttttctaacactgttcctaatatgattcaagtgtacggtaataacaaatcctcttacaatcagtgarggctgaagaaattagagaaactgggaacaattcctgatgctgagcggcctcttttgtcttcctaatgtatggcataggcactcttaatttctatatgagc

SEQ ID NO: 2782 - DNA, 201 bp, Homo sapiens
cactttccaagggctggacgtaactgtcagataaagagaaattagaactacgtgatgaatctactgaaagatagaccagaacctttctcattcagtcatgmtctagttgttaaactaaaccctgttttttgatttgggctccaaattcatttcttttattatttaagtgaaaccttatgacattcaaaagcaacttggagt

SEQ ID NO: 2783 - DNA, 201 bp, Homo sapiens
gtgacttagtagattggggtgttcctgcaccccagattttccagaacctccaacaactaaataatggattaactgattcattgcattttcctctcccttgygtggggaacacttttctctgccccgaagttcccaatttggcccataaataggaagtgatgtcaccctctgcctcaccagggaagtgctggccaccttcct

SEQ ID NO: 2784 - DNA, 201 bp, Homo sapiens
ccatgggctggggtctctcttgggccaggttaataggacagaatcgctgctcctccatggcccctcttgttttatccctttctttggatcagcagtggctygcaaacagtttacactggctggatcagctgtttaccatggagcaaaagccggccatggttccatgctgtgggtccctcctgctggccagtcatagagccc

SEQ ID NO: 2785 - DNA, 201 bp, Homo sapiens
agccccacttcccatccagcacacactgctggcacccccactcagcccccggcactgcccctgaatttctctcatagctagctagctctccattggcaacrctggtgcctgtccctgccagcagccccaagtcagcaccatgcccggctgttcattattaaattgaaaaaaggaggagggtcctgccttgattcccttcca

SEQ ID NO: 2786 - DNA, 201 bp, Homo sapiens
cccctgcccggcagggctcaagagaatctggggagcagcgggaccacctgtctccaccgaagcacccggcacccgctcaggtgttggtattactctctctmccacctgctacatgccagagccggggcagcccagggaggagaggaccctgccacagtcctcagcttgctgctggggcaaaaatcaacgagacaatgacag

SEQ ID NO: 2787 - DNA, 201 bp, Homo sapiens
actgcttgagtttttctagtagatttacttcatgtccaagcagctaagataataaaaacaatctgttgaatgagttcttgaatccttcctccaaaagcccrtaatattcttctaccaatgggatatggtagccttgggaaccacccccattatcattcaactacacttgcctcccaaaacgtctagcactaagatataata

SEQ ID NO: 2788 - DNA, 201 bp, Homo sapiens
tatttgaggacctgaactaatacacggaactactgttctgctgaacactgtgggaaaaatatgagagaaaaaaattatctctgactgaagagtggagcacrctactgaaatagacaagttgtctggcagaggacatctcatgaatacctctccctgccaaagtccaaactacagcatttgataaagtaaacactgaaatac

SEQ ID NO: 2789 - DNA, 201 bp, Homo sapiens
gaaatgcccaggctgcagcacctgcaggtgtgacccagctgactccaggccttcagagcagtcgttcttatccctgccagtggataggaatcacctgtggytttacagtgacctccacctccacctttggaggtcttgaatctgtattagcaaataacaactccctttctcctgcccccaagcaactctaatgtatatgct

SEQ ID NO: 2790 - DNA, 201 bp, Homo sapiens
attatatgcttgcttttattcattcctacagatgtttgagaaacagtggtaggatctggaagttcatgttggtatcctttgtccatggtgagttcccccarcaaatgaatagaagaagaaatttgattgaaaggattttgaagttggaaacgattttccttctttcattttgcactcaaggggaaaaaggtccataaagtt

SEQ ID NO: 2791 - DNA, 201 bp, Homo sapiens
gtcattctgtctgtaaggtccctttaggtagtgaaagggcagctggatgctgccctcacctgttccccccagcccacacggcacccctgcttctagctcargcctccttagtcagtgtgcccctcatgcgtcttgctgaggaattctggcagtctgtcagagctcttggcagtgtgctgtgggatctataactctgccacc

SEQ ID NO: 2792 - DNA, 201 bp, Homo sapiens
cagtaaaaaaattttttttcttttatccataattgttttcagaagtttattcagggtacttagtccactttagtaccataaaatatcttagtatcttaacrtagatattgagatagttggactagatcagtagttcttaacattttttggacacagactcgagaatctgataacagagcttggataacttctcctcgggaa

SEQ ID NO: 2793 - DNA, 201 bp, Homo sapiens
gctgctgctgtttgattaaatgttactccggcagcaggcagcggggttggaatgaagcagggaatttggagtcagggcatctgggttccccctccccacastttctaattgtgcggtgagggcaaggccctcagtttctctgagtttgtttctcatctataaaatgagtaccgccacacagatatgaaaaagaaattaaat

SEQ ID NO: 2794 - DNA, 201 bp, Homo sapiens
gcaaggccctcagtttctctgagtttgtttctcatctataaaatgagtaccgccacacagatatgaaaaagaaattaaataatgctcctcaagcttctggmtgtgttatgcaggaggaaggttatgctcagagtggttggaaacttggacccactttcaagataagtgatagaagaatctggatgaatcaagaccaggagg

SEQ ID NO: 2795 - DNA, 201 bp, Homo sapiens
aaattctaaggaaccagaagtggtttttcaattttgaaataaaaatgtcaactaataagagtgagaactcatatatccccaaggaagggcagtaatgtagrcaaaaaaaaaaaaaaaaggaagaaatgctgtcaatatctcaccctcaccctttagtgagagaggggtgatgtgttctggagtgtccgttaggttgttttt

SEQ ID NO: 2796 - DNA, 201 bp, Homo sapiens
tgtggtcagtgggtgcagggcaagatccaagggaagtggcctggcttgcagtgttggctgcccttggacactcctgaagaggtaaggacgttgtcagccaygtgctttattaggggaggatacatgataggtttcttgggcctccctaaaacagttgggtcaagctgggagtccccagcatatcacgtttgagtaggaaaa

SEQ ID NO: 2797 - DNA, 201 bp, Homo sapiens
gtgcagagaatgtggagattgtatcactgaattcaaaaagcacagaccctgaccagtctgggggttgtggtggtgaggacagttgtctgtcttaaagccartcctcagggcttggtcatgcacggcactgtctgtggcccttgcctgaatgaaccatacatgacacagcaaggtccctactcaaacaacagcagcagcaac

SEQ ID NO: 2798 - DNA, 201 bp, Homo sapiens
gggcacttctctttcctctgtggcctcgtagaggggagtccggaaaccatggctggctcagcaattccacttcctatgctacagattaaagacataaaaaraactaggattcataagttatggaaatgtaaggtctcaattccacaaagaacaagtctagagaaggcagaagctagaaatagatgttgacattacagatca

SEQ ID NO: 2799 - DNA, 201 bp, Homo sapiens
gctggcaaatggcagatgagattttaatccaaagacatgatcttttcattgtgctgcaatacttccctgaatgttaatcttactgaatgaatctgtaaatraattaatgaacgaacgagtgaagaaactattcagtcgcacatgtagtggcctccagtgcttctggagatgttttggggtctggaataatacaggaaggtt

SEQ ID NO: 2800 - DNA, 201 bp, Homo sapiens
gaaagagatgctgcaatatggaaaggagtctaatttatataaaatttcgtgtgaacatttacaagtttttgatgacatatctatttccatcaagtagatcrattcagtaacatttcctcaactttggcaagtcatgtgagcctctgtctacttagcgctgccctagggtccctgatcagagtcatcagggggatagatacc

SEQ ID NO: 2801 - DNA, 201 bp, Homo sapiens
aaatgctaacagtttttcttaaaaccatatatatacttattcgatgacccaacaatttcacttctggccgggcacagtggcttaccaggcctgttatcccrgcagcgagctgtaatcatattactgcactccagcctaagcaacagagtgagatcctgtcaaaaaaaaaaagaggccgaggtaggaggatcacttgagtcc

SEQ ID NO: 2802 - DNA, 201 bp, Homo sapiens
ctctctttgtagatgagaaattataccccagacagttaaagtgactcttctagggcaacacagataagtagaaggaccagaatttgatccctgaactcacygaatccagaatccacgcttttattcagtacccagaataaatagacaaataatccaatgtaaaaaacggtcagtgattttaaaacacactttccaaaaaaa

SEQ ID NO: 2803 - DNA, 201 bp, Homo sapiens
gattttaaaacacactttccaaaaaaaaagaaaaagaaaaagtgctcaacattagtcatcactaaaacgaaaattaaatctaaacaaaataccactttacrtccaacagaataagtaatttttttaaaaaaagaagaaaattaatgaaaccaaatgtttatgaaattaaggagcaactggaactcttataagttgatttag

SEQ ID NO: 2804 - DNA, 201 bp, Homo sapiens
ctgaagcgttgcacgcaggctttgattgatgtaagtttttgattttcagaatgttatatgcttgagttcatgtcatgaaaaaaaggtctgcattcatccckcagtgagagacgaatctctattctcctgctgatacatccatcagcatccttaatcatcctccttccgcggaggtttatcatccttctagttattctatta

SEQ ID NO: 2805 - DNA, 201 bp, Homo sapiens
ggagggggcccgcactgcaggcaggcaggatactcagaagccaacaaaagctgttccaagccaccaggtgagctagtttccaaatcattaattctctcttygcctgtatttgaaagtcaaagtatcccctttgatcagagcttaaagtcttaccctggggttcacgttcacgtataatcttcagagaggtcggagctctga

SEQ ID NO: 2806 - DNA, 201 bp, Homo sapiens
atgaaaacatatgtccacaaaaagtcttgtaaaagaatgctaattgcaactttatttataacggtttaaaactagtagcaactccagtgttcaccagtacragaatggataaataaggcacagtagattcatatcatggaataccactaagcaataaaaggttctaggcttcttcttttttttttttttttttttgagatg

SEQ ID NO: 2807 - DNA, 201 bp, Homo sapiens
aaatcctttgtctctgaagctatgacagataaaaaggagactggctcatgggaaggaccagtgcttctggcacctcctcttctctacaaggcagataagaytcaagaatcccaggctagtcatggggggatgttgacttgggtggagacaggatgtgtctctcatttattgaaattatgcaaacctgaggcctgaccttca

SEQ ID NO: 2808 - DNA, 201 bp, Homo sapiens
gtgggggaagagatgatgtggacagggatatatggtctaacattcacagtgctcctactgcttatcagatactgtgcttggttcatttgtgtcatattatsttgtgttttccataacacgtaaggcattccatgtgcaagacactgtgttaagtgccttatcaagcaacatctaatttaatccttataaaaacaatagaaa

SEQ ID NO: 2809 - DNA, 201 bp, Homo sapiens
ggttctcagcccccgcccaggaggtgcccagaaggagaccagaggacttgaagctcagtggccctgggagcctctgacctctctcccttgccccgtgacartggctgtcgctcaagctgtccgcatatcataaccacataccacttgcacgattatttatttaatatttttctttaagccaactctttttttcttttactt

SEQ ID NO: 2810 - DNA, 201 bp, Homo sapiens
gcatttcaaataaggaaatatgtctatgtggacattcattgcaacagtgttcatcataatgaaaaagcagaaatgtctacatgcccatcaacagggaaaargataaactgtgaaatagttctacagtagaataccataaagcagttaaaatcatgggtaaattttgaaatttcacactgttgtaagatctctggccacgcg

SEQ ID NO: 2811 - DNA, 201 bp, Homo sapiens
gcagcaaagagaatcagaaaggacagtgccccgtgctctcttggccctgggacccaaaagttaagttgagtgtaaaagctgggagccccgagactaaaaaygccacagtatttatggctgatgaatgcatcctgctcaggactgcagaaccatgtggggatctacgagcctgaaacatacaaatgggtgggtggccaaacc

SEQ ID NO: 2812 - DNA, 201 bp, Homo sapiens
ccccatctctctgggctcctgttttcctatttggacaacaaggggctgacttccgacttatcagggttcttctagtgctgatcatctaggagtcaagctgktgccccacaggccactctgcccactctgattttacccccacgctctcctgcctaatcctatatataaggccagaaatacccccaagagaggcctctgtag

SEQ ID NO: 2813 - DNA, 201 bp, Homo sapiens
ttcagattgctttgggaagtatagtcattttaacgatgttggttcttcctatagaatattttaccattggtttgtgtcatctaagatttccttcatcagtkctttgtagttcttcttgtaaatatctttcacctccctggttaaatatattcccggatattttaatttttgtttattataaattatattgagttcttgatg

SEQ ID NO: 2814 - DNA, 201 bp, Homo sapiens
acgcttagccctgagagactgagagtgggagatctcaagagtgtatcttgtacactatcactggtttgttttttaaatttggtggtgtggtacagtgttcrtaccagtgggtggtgcttgagactaagagccagctctacctggtgtagcccaataatgagtggaggcacctgccctgatgggaagtggtggggaagatgt

SEQ ID NO: 2815 - DNA, 201 bp, Homo sapiens
ctcatgaaatgggtatagagtaagggatagagaaatggcaataatagacctacagttatatggcagcatcattttcttattcagagacagacggatgaggmgcacttgagggggaaattggtggttcttctaacatgctaattttgatattcatttggagatataaagacataggatatatgagtaatacttcagaaagtt

SEQ ID NO: 2816 - DNA, 201 bp, Homo sapiens
ataaagagcacttttatgtgtgtgagtatattggccctataaaaaaatctttgctgtatcttgcttgagctatttcattaatttctcaggctaactccccrattttacactctagtttcaaaacactctgccccctttcgttaagccaatctttatgagatttaagatagaaggtttgagaatccttcagtggctttccta

SEQ ID NO: 2817 - DNA, 201 bp, Homo sapiens
cattagggctaaattatgtttgacctccagaaactttatttcccaacagggttttaaatctttcacataaataaagacctggcaaacctctccctgttttmtgtccctagcctggacagaagagtattttgagtaaatgcagtttaagactaagttgggaatgttctttttgttttaaattcttaacttttaatttttgtg

SEQ ID NO: 2818 - DNA, 201 bp, Homo sapiens
tgttttcatttttatttggtttaaaacatgttgtaatttcagttgagatttcttcttagacaaattgttatttagaactctgctgtttatgagtatttgcrgattctccagctatctttttgtttttgatttcaagtttaattccattgtgttctgagagcaggaattatatgattcccattctcctaaatttgttaaggt

SEQ ID NO: 2819 - DNA, 201 bp, Homo sapiens
cctgatgtatagaacctgagaaaggatctcctaagccaggtggcttaaacccacttctgaagtatattattccttatcttctgagtccctgcaaaatgagmggggagcccagaaaaatgagtggggaactcagatcagtgtattctggagtggcagtggaatcagtcttccttcttctatattatttcctccatatcacaa

SEQ ID NO: 2820 - DNA, 201 bp, Homo sapiens
tcccacttttacagccacctgtgtctccttcccatcttctttttcctaatctacacctttttgtaccttcgtacattttgtacacttttaattcacttttrtacatggctctactgtcctctgtaaatgttttaaaaaaaatgaaaaaaaataccctccaactccccacaatgaaaaatatttatgcattttatttgtctt

SEQ ID NO: 2821 - DNA, 201 bp, Homo sapiens
agcccacgatagttaaacttgtaaattaaatgatgcttgatgaggaaaagggcaggatttgtgttgtttttatttttgttttgtttgagtagattgaaatyagcagctcttgagaaaagtctgccttttcattctaaaaaagaaaaactcctgaaatacatgatttgcacatgtatttaatatagttacaacaaaaaattg

SEQ ID NO: 2822 - DNA, 201 bp, Homo sapiens
atatggacctgtcctgcaatagcctaataataatatattctaaactaaataacagtatccagtgtcaatttataaatcaaataaatgagcatatttactgycagtttagaaaaatatatatatagctttgttgctcatttgccacaggaaaaccaccacagaattattctatatttttaaattatattttatttgggttat

SEQ ID NO: 2823 - DNA, 201 bp, Homo sapiens
atacagtatgtcaaataaaaactgccagggagaaaaaaaaggaaaggtaatcttggtgacaggtgaacaccttagttataggaacatcttagtttaaacayagtttctgagtttgcaagttatatactaaatagcaccaccatatggagcagatgtaggcaaagccacaaacactaagaaaatgaggtcacaattgtggaa

SEQ ID NO: 2824 - DNA, 201 bp, Homo sapiens
gtaaaattgaaaaaacatggaactttgggatataggcaaattggggtctaaatttccaggttgtgtgatctttgaaccttaatttcctcacctgcaaaatsggttattaatatccccaacttggcagagttgagaggattaagtgaagaagagaatgtgcccggcacacagcaggtgcacaaaaaatgccagctgtcatgc

SEQ ID NO: 2825 - DNA, 201 bp, Homo sapiens
aagcaagctgaaaaaaaaaaaacctgaactattttgtttttctacaactgtatgcaattgtggaagctgttgaaggatcccaggaactatcagtccaaaayatgatgcaatggtttgctgactacttcaagctaaaggcatttgagaaatagcaaatgcacagaaggtcttttttttttctttctgaatctcccttaccta

SEQ ID NO: 2826 - DNA, 201 bp, Homo sapiens
ccaaaaagtatcatccaaactcctcaggacaggatcacctgtgatcatttttggatgttgggaaagccagcctcaaactattagcttaggtttgaagtttmttcttaatctagttcataattccacgtatttcaaaggaaaaaagagagacctttcaggcaggtgggatgcatttcaagtggagcagaccctgctttcaac

SEQ ID NO: 2827 - DNA, 201 bp, Homo sapiens
gggtaccaccccaggattatttaattgatctgggctggggaataggcatttgtatttgaaaagcttttcagatgattttcacaagtgaccaatgttaggarccaccaacctagagggagctgtccccggctcttagggaggcaggggtcaaagtaaaacaagttaaatacaaacaattgacgttggcttcatgatccatca

SEQ ID NO: 2828 - DNA, 201 bp, Homo sapiens
gcactaagagaaggactcctgagggaagtgacatttaagccaaggcctgatgggtgcttcagggaagggcagtgaatgtctgaggcagccaccaagaaaayggttcaggggaagcacaccagcttctctcatgcaccttcacatttcagaatgtgacacctgtcctggaaactgatcactgaattgagcaaaccaacagga

SEQ ID NO: 2829 - DNA, 201 bp, Homo sapiens
tgagctgacggagtgatggtgcttctgggaaggaagggcccatgggagcatcttgcccacctttcagtgctaaccaaaccaaccatctctggagggttgaycctggacatgcattcctttcactctgcaccctcgtggccatttggccctcctgaccacgccacaagtgtggatcttgggggaagaagccaaggttcaaga

SEQ ID NO: 2830 - DNA, 201 bp, Homo sapiens
ttgctcttaccatctggtatttctgattgtagcctggtgccatctggggttcagagcttcctaaactttctgtacaagtgttgtccgtctaacctacttamcctttgtaattctattgtgatttgcttggctgaattataactcatattgagaggtgaagccagctggacttcctgggtcaagtggggacttggagaactt

SEQ ID NO: 2831 - DNA, 201 bp, Homo sapiens
aaaaaaaaaaaaagagacaacacagagacagaggagaagcccacgtgaggctggagtgatgtggccacaaaccaaggaacacctggagccaccaggagctrgaaggctggctggaagaggcaggaaggtacttccctagagcctctggagggagtggagccctgcccacaccttgattgcagacttctggcctccggagct

SEQ ID NO: 2832 - DNA, 201 bp, Homo sapiens; identical to SEQ ID NO: 1119

SEQ ID NO: 2833 - DNA, 201 bp, Homo sapiens; identical to SEQ ID NO: 1120

SEQ ID NO: 2834 - DNA, 201 bp, Homo sapiens
aaataaagcaagatggcatgtggagagcaaatgtaaattagaaactggttaaacataaaacgacaaagaccatcaacttgtattacaaaacagaaggcaamtatattctgcatccaagagcacactgaaaacagaggaatctagaaaacttcacattcaaagggtgtgaaaacatgtcaatgaactcaagttaaaagaaac

SEQ ID NO: 2835 - DNA, 201 bp, Homo sapiens
ctaataacagcttccctaatttttgtcccagcttccaacttagaaccaaccagaaaatctgctgccctaactgaccacacaggaggccccgtttctggtcrgccaccccagcttccccaagccaacagcctccactcggagtgcacctggagcctcctctttttccactgtgaacttttcccatcctctgtctgcctggaa

SEQ ID NO: 2836 - DNA, 201 bp, Homo sapiens
gaggaggaaagagttctaggcaaagacataagtcaacacatggaagatgtacattggtgtgacctgaatatgtgggacatcttgaagcaggggtttacagrttatagatggattcagagattctctaatttgcagttggttaaaggagtaagctctgtctaaaatttgatgtcagcggaaaggcatgttttaagttaagga

SEQ ID NO: 2837 - DNA, 201 bp, Homo sapiens
cccaccccactggggtcctggttgccctccctagcttctgaaatcaccccccacacccccaacaaccaccacatacacctttcaccagagactcacccagygcttccagaagctggggcaaagaggagcacacacgaccacctgcctactgagcagctcacacttcctccaatggagccaccacaaggtaccggcctccag

SEQ ID NO: 2838 - DNA, 201 bp, Homo sapiens
gggcgacagagcaagactctatctcaaaacaaaaacaaaaacaaaaaacatgtaacatagctccactgtacagcgtttgcttacagaggttgcttctgcartgaagagaattaggcatctgacttgaggtatgattacagactgcagtgaaagctggaagttgaaaagtggaagagttatgtgctgagtataaattctggt

SEQ ID NO: 2839 - DNA, 201 bp, Homo sapiens
tcagttctaagcaactaacttaccaacttttcaaacacaatttgtctgcgtagagaagaccagcacacaggaagaaaacaataacagaggcagcattgcarttctcaggtacacacaggacaaccgaggcatggtaagtgaaatatataaccaactttctcataaaaagtaagtttgtaacaaatatgagagcagaattcg

SEQ ID NO: 2840 - DNA, 201 bp, Homo sapiens
caatgtgttgtgacttcccctcttggaaaggaagtgttctcagtgagtggtgattctcttctgcttaaatttagagaaacttggttcagattggcttggayttctgatggctagggatccaagatgaagggtcattctcaactctcttaatcagaattttgatcagaggaaaaaagaacacaagagaggagacaactctga

SEQ ID NO: 2841 - DNA, 201 bp, Homo sapiens
tacagaattgaatgtcattaaacggcacaccaagcgcatccatacatatgtgtgtcctaggaaatatatatataggatgtactcggaaagggacaagaaayggacagttggaacttcagtgggaagtgaagatcctttggggatgtatgcattcttactgcatgcttgtgttattcttccaaaaatgttctaccagcctca

SEQ ID NO: 2842 - DNA, 201 bp, Homo sapiens
tgcctacgtctgtgccactggggggctgtgttcagtgtggatgtggggctctgtggtccttctgtcatccctggatccagagttactcctgggggcccagwcacctctgtaattcaagttgctgggctactgtgaggcccaaaacgtttgtggggagcagagaatgaaggagcctcagcacccactccctatcctggccac

SEQ ID NO: 2843 - DNA, 201 bp, Homo sapiens
gacgcacctgattgtgtgttctgaggtggggaatctgggcatggccaacccggagagtcactccttgtctatgagaaacatccgagccctgggcccatccrgaacatgggctgtgcatggaattgaggccctgagttttgggttaactgaaggttgccaggtagaggttgttaagggtagagtgttaagtggccatgctat

SEQ ID NO: 2844 - DNA, 201 bp, Homo sapiens
aggaaggggtgtgtgtggctggatcaattcatccatgtcgctcacttggctccacttccctcctccttccgcccctctccccctcgctgagaccaagagcrtaaattccttctggctattaattaaaagcagcctctcccttcgcgccagtgtactcgccataaattaatagcggtcttcttaatcaaatcttatctcctc

SEQ ID NO: 2845 - DNA, 201 bp, Homo sapiens
tactgtatgctcctccctaagccaattattctactgtgtgctggagtagtcccaggatgcaagaaattcacgctccagctcacagtgatgaatgcacgtgrgtgcaggtgcacacacaaacacacaaccctgaagggcaaggagatgtctcttctagtccctcccaaggtgcagagttgtaggtgctcaaagcattcagaa

SEQ ID NO: 2846 - DNA, 201 bp, Homo sapiens
ggacgggccagggcagagcctggacagaggacacaactgccagccttgctccagctgccaagtaactttgagccaataccaactggggcgccctctggcaygcctctgtccctgggtcactccagcatcaccaccctacttagcagctgacagtctccagcaatttccctttggccgcagggtggctcgggccatctctgc

SEQ ID NO: 2847 - DNA, 201 bp, Homo sapiens
tggcctcccaaagtttggattacaggtgtgagccaccgcacccggtcttaactgtttctatatgtaaggcatttctcctgtccagacagctgccactggaycctcccctggatgtaagcccctaataaaaccctatgtctcctttgctggcgccgggtctcttcttcagcttctcgaacctggtgccttccctattgaggt

SEQ ID NO: 2848 - DNA, 201 bp, Homo sapiens
cctattgtaaccaccgtgcgtgacaccaagagctttggggaatctacggaatcaaagagtcacagacacatggcctggccacatgcccgtctcccaagcayatttcagggtttaacctcagctcaccccggtaatgctgtgtttgcagcgcatgggggtgtccgtagctcgccggtgtcacaggatcaccccagagtggtg

SEQ ID NO: 2849 - DNA, 201 bp, Homo sapiens
cccgcagagccactgcggattagcaggtgttacagaggtgctgagtgccattagcacctaattacgcctttgtccttgctgtaatcaggtgaacagagaarggactgaaaaggggagcgccttaaagagaaagcaagcagctgtcaggcaggaatctcttccaatgtgtccactcctctctagaatgtggcctccttccca

SEQ ID NO: 2850 - DNA, 201 bp, Homo sapiens
cagctgtcaggcaggaatctcttccaatgtgtccactcctctctagaatgtggcctccttcccacggccagagggcctgggccattcaggtggccagaaargatacagccagttacagactcttacatgctgcctcttaaacccacacggaatcgaagtctgggctcatcaggaaacagggagccgatgagggcctttgag

SEQ ID NO: 2851 - DNA, 201 bp, Homo sapiens
tattctactgtgtgctggagtagtcccaggatgcaagaaattcacgctccagctcacagtgatgaatgcacgtgagtgcaggtgcacacacaaacacacarccctgaagggcaaggagatgtctcttctagtccctcccaaggtgcagagttgtaggtgctcaaagcattcagaaaaatagaatgggaatgagggtgaccc

SEQ ID NO: 2852 - DNA, 201 bp, Homo sapiens
gccacatgcctcttgcccccaatgctggagaggtcactggttgacaccacaggtgatctcacccctggggtgcatgagtccaagggtaggggagttagcaycccaactggagaggagagccagtccaggaatccccctttttccatggcagaggaggcatccccggaacgaggttggtgtggcttctcagagccacagtcc

SEQ ID NO: 2853 - DNA, 201 bp, Homo sapiens
aagatcctgacttaacattgaaaaaaggtacaattatccccaaacatttccagctgacataaatatgcacaccccatctaaaaagtacagcaaacctgaargccccattggctgatactagtaacccatttctctggaatcagatgatttattttcctttgaatgtatcatttctgaagtaataggttaatattattttta

SEQ ID NO: 2854 - DNA, 201 bp, Homo sapiens
tatggaattatcttcctgggggaagagttctctgtcattcataggtgttcagacagaagctagacagtcacagacaggactattgcaaggaagagctcagyatccgatggggctgggttagcttttcattgccttcctattgaggattccaagatgcaatatttaatgaaaagttatttcatatgtctaccttgcttagag

SEQ ID NO: 2855 - DNA, 201 bp, Homo sapiens
ccccactcctcagcaccccccagtcggacatccagccactaaaacactctcctttaggccagcagaggcttgcgtgatgataagcctgccatcttgctcaktttcttcatggctcttggaagccttgcacaccgctaagcttcttgaaacacccactccccggcttcctgaggaaccactctctgtttaccctctgaccct

SEQ ID NO: 2856 - DNA, 201 bp, Homo sapiens
gtgtcaggccccatgcagtctcacctccagccagtcctcctctgggacacatgccccagacacagggctgtattttttattcttgggtgccaagctttctytgacctgggaggtttctttcatgggtttgctgtatctctaaccctcttctttcctgccctcctaattcccttctccatctctccttccctcctcctctat

SEQ ID NO: 2857 - DNA, 201 bp, Homo sapiens
gcatgggagcataaggtgggaaagggaagggagaggagttttaaagcacattccaaggctgtatttcaagatgaaagaaaacacatctgtagtttgtctcraagcacaccttgagactgggaagaaagaaggaaagaaaataaaagtttttgttttttattttttgggttttttttagacggagtctcactctgtcatcag

SEQ ID NO: 2858 - DNA, 201 bp, Homo sapiens
ctctagcggtgagttcagtattcccaaatcttctctgtctacatacagaagacttaagagatcagtatgtcccaaactagttggagtaaggataatatcaraggtagaaaaaaaagataagctttttggctatgggataaaatacaagtaaacgttaacagtggtccttcttgcttcccaccttcttcccaaagttcccaa

SEQ ID NO: 2859 - DNA, 201 bp, Homo sapiens
agaagcattcctccaggggtgccttcttccctcctgttgattatggtggttttgcttctgattgtaccctatgaaagaccatctattcactctttcctcarcagcctggcttcctcaagagaaattacccttgtactgctgaggttctggaatctaacctccacatcgtccatgaactctgaatagtgctactgtcgaact

SEQ ID NO: 2860 - DNA, 201 bp, Homo sapiens
aacagattatttcatctactaccgtgagttagctaccattattatcacaaaactatcattatcaccatctgaggttatcctggcccagaggtatcaggtcrcctgtccacacccatatagctattaggtggcagaacctggaacaaagtgagtcttcatgcagctcatgctccttgccattctgctcctacaagtgtgcat

SEQ ID NO: 2861 - DNA, 201 bp, Homo sapiens
agaattgattcagagggttgctgactgtataacctttgaaataatgtattcctatattttataatgcctgtcaatgttaagaatattgtcttacaagctarcatatttgttttgttaataagtttttttcttgtctatgctcgtggattcattttgtgtcagcatactaaaaagttttaccatgtactgcagtcaaattaa

SEQ ID NO: 2862 - DNA, 201 bp, Homo sapiens
taatccccatgtgtagagggagggagggggttgattgaatcatgggggtgggctccccccatgctgttctcatgatagtgagttcttacaagatctgatgrttttaataaatggtagcttttcctgcactcatatgctctgtctctcttgctgccttgtaagatgtacctggtttgccctctgccatgattgtaagtttcc

SEQ ID NO: 2863 - DNA, 201 bp, Homo sapiens
tgccatgattgtaagtttcctgaagcctccccagccatgtggaactgtgagtcaatgaaaactctttcctttgtaaattacccagtcttgagtttctttayagcagtgtgaaaacagattaacacacctagtctgaggtatttagtcatgggaatcctaacaagataatacaagagctttgcaaatatcgagctttgaaac

SEQ ID NO: 2864 - DNA, 201 bp, Homo sapiens
gaacagtgtaatagtaagtgaaatatacataccagattttcctggcgatatctttgtttttgttcaaagatctgtttattaattgataggttcaaagatayactacttgactttgggggctggaagaaagtggtggtagaagctgtagtttttaccagaacctgtctttaggaaccaagttatgagtggttctctagtcct

SEQ ID NO: 2865 - DNA, 201 bp, Homo sapiens
gtgactttttagggctgtctctttcctcctttatggagtattcttagcctgtgttcttttctttccttctgttcaaaattctgacagctcacctcaagctkcacattgacctgccaaatcaccctaatgtctactttgtgcttttggtaacatcatgaactcctagttttaccctttgcctgtcatttagtttcttaattt

SEQ ID NO: 2866 - DNA, 201 bp, Homo sapiens
cgtggttttttccattaaaagtaatgtgtcagcctctgcgatgtgttggtgagcattcagaggcataagtgagagaagaggagtaagcgttgcattttctrttagttctagtacccaacatttaaggaattctggggagtggttgtccagccccatccactgcttagtatatattggcaagaaggaaggaggaggtttttg

SEQ ID NO: 2867 - DNA, 201 bp, Homo sapiens
atagtttgccttcctttcttcctatttggatggcttttatttctttctcttgcctgattgccctggcctagactatgttgaataggaatggggagagatgrcatctttgtcttgtgttagttttcaaggggaatgcctccaacttttgcccattcagtgtgacgttagctgtaggtatgtcataggtggcttttattattt

SEQ ID NO: 2868 - DNA, 201 bp, Homo sapiens
aaaagtggtgaagaaataaaacaggataaaagacaagtaaagaaaacctgaaattgagcagcatccttaagacagttatgaaaacagaatagttactgacwtagaaaaatcctattcatttcattgctttttctttaaaacattttctactgtggtaaaataatataacaatttctgttctccctttattatctagctatt

SEQ ID NO: 2869 - DNA, 201 bp, Homo sapiens
tggtttctaaaatagttccatgctggtcaggtcattggaagaggcttcctgttcttttataaacattctaacatggagactggcaaagcagagtttttgcragaaaagaactgattttaaaaaggtggcttcttagattgatgtgttttaactttgtctgctgaatctaaagaataaggagagatcatcgcaaagtaaatg

SEQ ID NO: 2870 - DNA, 201 bp, Homo sapiens
catctgttcctgggctttttctggttggtagaaaagtatgataattttccttcatactttacatctcttcgatttagaaatctttggattttaatttttaracagatttaatcttcagattttacttttccctgggaatttgctggggtaggagtcatagccaaatctgaggtatcttgggttcattgtacttttacaata

SEQ ID NO: 2871 - DNA, 201 bp, Homo sapiens
tttcccacagccttgacatggctggttgtcaagtagctcctcatatataagggatgtttaggtcaggaaaaattgtccagaggcgaacccgaataaatgartggtgaacctggtgggtgatgcggcgacaagaagcatggtgataaaaatccatgggaatgggaagaaaggaaggggagaggcagactgcatttctgacca

SEQ ID NO: 2872 - DNA, 201 bp, Homo sapiens
ttccagtagcatcactgccaaaagcgtgatgtgtttattgcaactgttgcacgttgtgcggactaggccgtttcacacggtgagcgatggcgagctgggtstctcgctgtattttccagtctgttttctcgctttgtacttctcaaaacgaagctgtcactttccgtaagaggccagttctgccttgactctgagaagctc

SEQ ID NO: 2873 - DNA, 201 bp, Homo sapiens
aagccgcagacatttattgagcaccagctgtgtgctaggtcatgtgctgggttcgaggaaacagtagggacaagacgccctccagtgggggccaggggagrcatcagggtgggcttcctggaggaggcaacacatacactgagattggaatgatgactcgaaattcggtcctgaagaagggaagggaagaggattgtcgag

SEQ ID NO: 2874 - DNA, 201 bp, Homo sapiens; identical to SEQ ID NO: 1356

SEQ ID NO: 2875 - DNA, 201 bp, Homo sapiens
gtggctccagcctggctcctgggatggtggcagccccaggggactgcctcattctgccacctgcccattccctggctctccttcacctttgtccctcaccrgcagcagaagcacagatggctgttccgtcatccagcacgtgctgcggtgcatgtcacagggcaaggtgctgagcagctgtctggtccccaacacctggtg

SEQ ID NO: 2876 - DNA, 201 bp, Homo sapiens
gaggtcagacagaaatgagaaacatgttattggacactggaggaaaggagattcttgttataaagtgagagaaaacttggcttaattacattgtacagttrggtggaaagcagaacttgtaagtgatacaattgtatatatagctgaggagatttccaagcaaggtgtggtctgatttctcctttctgtttagagtaaaat

SEQ ID NO: 2877 - DNA, 201 bp, Homo sapiens
ttggaaggtgattaggtcatgatagcagagtcttcatcagttagattagtgcccttataaaagagtcccaaggagcttgttcaccccttctgccatgtgarggcacatagaagttgccatctgtgagcaatggaccctcatcaaacactaaatctgttagtgccttgatctcagacttcctaacatccagaactagcttcc

SEQ ID NO: 2878 - DNA, 201 bp, Homo sapiens
tggtatacttgacggtgactcacaggattctgaggctgtgtttatttttattcacttttttctttctcaaatgagatatgtcaattaacatacattcaagwtcattcattttttattctgccgtctcaaatctgctattgagccactctagtgaaatttttgtttaaggttattagataattctgctccagaatttttatg

SEQ ID NO: 2879 - DNA, 201 bp, Homo sapiens
acagtgttgcaaacaaaaaagcacttatactttctttaaatttacagatgtagttacctgtatggtgctattcattcctgtgcatgcaagttattgtctcrtgtctctttctttcagcctgaacattccctttatcatttcttttggggaaggtatgctaacgaatagttctttgaattttgattttctgggaatgtctta

SEQ ID NO: 2880 - DNA, 201 bp, Homo sapiens
cagaaagttcaaggcctggccacattaagctttggtatcacagtgctgcacacttcgcctatcatttgtgaggcaggaacactggctttagaaacattttmcatttaggacataagaacagccaaatcttctaagtcttcaattttattcattcaccagaccaaaatcataaactctgtcacaaaaaaaaaaaaaaaaaaa

SEQ ID NO: 2881 - DNA, 201 bp, Homo sapiens
gttttctgctgctataacagaataccacagactgggtaagttataaacaacagaactttatttggcttataactctgaaggctgggaagctcaggagcacrgtaccagcatctggtgagggtcatcctatggcagaaggaaaaaggcagaagcttgcatgctaaacagaaaaagcaaaatgggacctgaaatattcttttt

SEQ ID NO: 2882 - DNA, 201 bp, Homo sapiens
aatggcattgctttcttgatttttttcagacagtcattgttagtgtatagaaatgatcctgacttttctttgttgattttattttttgtaactttactcargacatttcttacttgtaacaggtttgtttttttttttttcagtagtctttaaggttttcaatatataagatcatgctgtctgcatcagaactcttttctt

SEQ ID NO: 2883 - DNA, 201 bp, Homo sapiens
ctgtgttccttgaatttccatgcgaatattaggaacagtttgtcagtttttgcaaaaagaaggtatttgatattttgatgcagtttaaattgagtctgcarattaatttggggagcattattatttgaacaatattaaatcttttaattcatgaagatgggtttcctttttttttcatttagttcttaatttcctttaatg

SEQ ID NO: 2884 - DNA, 201 bp, Homo sapiens
catcagcttatttaatcatcacaacaattccttacaattcctttaaaaataaaagaaagattgttgttcctattgacagatggactggggagattaaaggmtttcccaagtagcaaattcacagccaacatgaaagttcactacacaagaaggatggaggcaatgaggctgagtgagagcagccaccctgtgtccagcaca

SEQ ID NO: 2885 - DNA, 201 bp, Homo sapiens
ggtgatcatgttgacaaagtcacaggctataaatgggcccaaaaagatgaactcccactaaccaaggcagatctactgacacctctgaatttctccttttyagtaacagagaccaatgctaacacccattatggcactattcctcaaggaaattgactacttggtgagaaattacattgggtagcttctaccccaaaaaca

SEQ ID NO: 2886 - DNA, 201 bp, Homo sapiens
attgactacttggtgagaaattacattgggtagcttctaccccaaaaacagtgctactcatcctcaaagctatgataaatacttgttttgggtatgggctwacttctacccacaaagccatagccagcatcactatcggaaggcttagagagtgcagtggatcaacactctgtaagcctcctatacacatgtcagcagatc

SEQ ID NO: 2887 - DNA, 201 bp, Homo sapiens
cctcctatacacatgtcagcagatcaggggactgacatgagatgaaggtggtgaaggaaatgctggagtggtccatgactgggtgccacgcttcagaatastgtgtacttattaaaacaaagatctctctatatggtgccctgtcccctataggaaggatacatgtgttcagaaaccaaaagatggaagcatgcatagctc

SEQ ID NO: 2888 - DNA, 201 bp, Homo sapiens
agtgaaagggcagttttgttatgtttacaaggagactgaacatggattcattctgctactagaatacaaatgtgagcaaaagggtgtgggatagtatgtcyagttcattgttttgtgaaaaggctacagggatgataacacaagtgggaattcagctctgatatggtaaaacatttatcctgaaatccaaaatgtagaaac

SEQ ID NO: 2889 - DNA, 201 bp, Homo sapiens
cagaaaccaaaagatggaagcatgcatagctccacttaccaagactccttacgattcatgggaggaatttatgatttatgtccctataactctaggctctkcagggttgaaggtcgtggtctccaaacaggtacactcttgttgttgcggctctgggactgacattgtggtgacagcatcgtgcccctgggataacagcta

SEQ ID NO: 2890 - DNA, 201 bp, Homo sapiens
agttattcactcatatatacatagtaaatgatactatttttatcagcattattataactattttaattgccattttaaaatactttactatacattacctygtttaatcatttcaataattctgaagataattggtgtatcttacatgtaaggaaactgatataaaggtctaagtatcttctacaacctcaagcaggaata

SEQ ID NO: 2891 - DNA, 201 bp, Homo sapiens
tttcccattgtgtattctttgcatctttgtgaaaaatctgttgataaatgcacaaacttgtttctgtgctatcagttatgttgttggtgtatgtttctgtytttatggcagtgccatgctgtattgattgctatagatttgtatgatattttgaaatcagagactgcgatgcctccaactttgttcttttcgctcaagatt

SEQ ID NO: 2892 - DNA, 201 bp, Homo sapiens
agccactgcactccagcctgggcaatagggcaagaccttgtctcaaaaaaaaaaaaaaaaaaaaaatacaaaaacccacaaaaaacaaaacaaaaacaatrtactcgtgaacagaacaagaatgttttaaatgaagcaatctgagaataaaaaatgctatatatgtgtacatataaatgcatataacataattatacaatg

SEQ ID NO: 2893 - DNA, 201 bp, Homo sapiens
agccaggtgtgatggtgtgcacctgtacacccagctattagggaggctgaggtgggaggattgcttgagcctaggaggctgaggctgcagtgagccatgakcacctctcagcactccagcctgggtgacagaagaaagaaggaaggaaggaaggaaagaaagaaagaaagaaaagaaagaaaaaaagaagaaagaaagaaa

SEQ ID NO: 2894 - DNA, 201 bp, Homo sapiens
actccatttccggcacaaccctccccaaactcagtcacgtgcctcattcatctttgtttcaagactccactctccaaccccagctcagcaccttgcacatmgcagatactcaaaatgttgttgacttgaaaacacaaatattcatcaggttgaatcaatattgttcttttcaggggattcaaagagagaaagaaccagttt

SEQ ID NO: 2895 - DNA, 201 bp, Homo sapiens
gctagaaaaaaaccaaataggcttctctgaaaaaacaaggtttaatcaaggatcttgagaaaataaccagctgttttatgagcaatttgactattcttttsaaaagagttaatgtaccacaaggaacacaattatttttagagccctaaggaagcagggatttgtttgaagctccagattaaaggtggatccaaggttcta

SEQ ID NO: 2896 - DNA, 201 bp, Homo sapiens
tccatgcccttttcatctcctggcacatttctgcctatctttcaaaacagctcaaaaattacctcctcagggaagcctcccctgtctgctgggccaacttyaatggcccttctctgggttgttgcaattgtcatcccctgcaatcctccaacctagtgcttgtcatgccgtattgtaaaaaatgggctttgtgtctctctc

SEQ ID NO: 2897 - DNA, 201 bp, Homo sapiens
ttggacagctccacccttgtggctttgcagggtaaagcccccgtcctggctgctttcccaggctggcattgagtgtctgcagattttccaggtgaatggcrcaagctgtcggtggatctaccactctggggtctggaggatagtgaccctcttctcacagctccactaggcagtgccccagtagggactcagtgtctgggg

SEQ ID NO: 2898 - DNA, 201 bp, Homo sapiens
gtatgatacatagcaaatttcattattcatttcttcaaacaataattacagggcatggacccagggccaaacaccatgctaagtgctgggaaaacacagaygcagcctcagtgatgaactgggaaaataggcatggaatggataattataagagattctgattaagttctgtaagaagactgtgtaccttgctgaaaatga

SEQ ID NO: 2899 - DNA, 201 bp, Homo sapiens
attcaggaggtacatgttctggtttgttacctgggtatactgcatgatgctgaggtttggggtacaaatgatcccatcacccaggtactgagaatagcackcaacagttagttcttcagctgttgtccccctccttgtctcttccctctggtagtctccagtgtctattgtttctttggcatttttagattcattaggaac

SEQ ID NO: 2900 - DNA, 201 bp, Homo sapiens
tgtcaagaatgtaagtcatccagcattactgacttcattggttgaattataaatccacgataatagtgttgggcacaatcacagattaaaaaacggtgaayggaattgtgagtgttcccatttgtgtgatttcccacttctctttttctttgctttaaatgtgaggcccattttctatggctcctgatgctgatttggatg

SEQ ID NO: 2901 - DNA, 201 bp, Homo sapiens
ctttaagattagacatttaaaatcagaattatctaatgcaacctagggccttttcttggaggttcacacttttgttttgcacaaagagaagggctttctcktatacacccatgccccacacccatctcaatcttctgatgttcacataacattgaggtaggccatgaaaaatttcgaagcaggcatacattgtagcccaag

SEQ ID NO: 2902 - DNA, 201 bp, Homo sapiens
ctggtgggaatgcaacatggtgaaattgctttgaagcataacttcacagtttcttataaaaagttaaatgtacacttaacaatatgacccagcagttgcayacccaagggaatcacacacccatgtatccatatgtgaacacccacaaacttgtacacaaatatttaaaacacctccatttataattgccaaaagtcagaa

SEQ ID NO: 2903 - DNA, 201 bp, Homo sapiens
gcaaaaaaaagaatgacctgtgttatacaaaacaatacataggagagtcagtatcattttgctgggtgaaaggagccagactcaaaaggacacatactgtygattccatactgtgtgattccatttatatgacttgttcaaaaaggcaaaattacagggttagtaatcagaccagtggcttccaggggctaggggtgaagg

SEQ ID NO: 2904 - DNA, 201 bp, Homo sapiens
ttccaaatgttccgtaatcaacacatacaactttcagaatgtgaaaagttaatgttttgagaaaaaataccacactacagacataaaagacactagaaatmtaaacatgctgtgggccatggtggaaggcctggaaatttttcatattttaagttgtatacacacttttaggcatacatattttttctgtatatgtatgtg

SEQ ID NO: 2905 - DNA, 201 bp, Homo sapiens
ggaaggcaataagaaagtgaaagggatcaattgattattaggagatttgcaacctaacagtgtattatatccctaggctcaggctgcttccgatagagggmacactcctgaagggctttcagtcaaatcttaaaaactcttaattttgtttccccactgatacacgtcttttaatgttcttaagtcattcctggtagatct

SEQ ID NO: 2906 - DNA, 201 bp, Homo sapiens
tttgatggttgtgatttcatgataattgaggtagttgatgttggcagaaggaaaagggacactagcaaaattgaaattaaaaatcagtgccaaaatgcttygggttacatagggaaaaaacaagctaaactaaaccaaaaaccctcttactattctactatgctttttttggccccacccctactctagagaaaggagcct

SEQ ID NO: 2907 - DNA, 201 bp, Homo sapiens
ctaaatgtcctatctctatgttcaacatgagagagcaagggtaacaaaagacaaaaacaaacaaaaaagtctgaagtagttgaagacaaaggataaggaawtcctaggaggagtctgagtccacttacaaattgcacctaaggaagagtcctcagactcatgaagttcatttcggctttgctgcattaataaaccagccag

SEQ ID NO: 2908 - DNA, 201 bp, Homo sapiens
agccgaggcctgtctggggctgcagaatctggaagaggcaagaaaggattctccttcatgatcctcagagggagcgtgtccctgctaacaccttgatttcwtacttctagctcccagcactgtgagacaatgactctgttgttctaagtcatccagtttgtggtcttttgttatagcagccccaggaaactaatacaccca

SEQ ID NO: 2909 - DNA, 201 bp, Homo sapiens
gcacaaaaaccctcccaagactgaactaggaagaaactgattccctgaacagaccaataatgagctccaaaactgaatctgtaacaaataacctaccaacmaaaaaaatcctaggaccagatagattcacagccaaattctaccagatgcacaaagaaaatctggtaccattcctactgaaactattccaaaaaactgagg

SEQ ID NO: 2910 - DNA, 201 bp, Homo sapiens
ccagaaaaattgaagagatatatgcaaaaaacaaatctcaatctttaccctacactatacataaaaattaagatgaaagacaggatagactggggaactgrttgaagaagactaaggagacacagcagtggatgcaatatgagatcctggattggctcttggaacagaaaagtacattgtggggaaactggcaaaatttaa

SEQ ID NO: 2911 - DNA, 201 bp, Homo sapiens
tgtaccatatgcctaacccctaggggatgtcttaaaaattctccaaactaaattttcttaaaagttctcctaactgaatttcccccaaattgcatacaccrttatgcctccaagttctgcttcttttcctaggctatatttcctgacgtgtcttctgcagcccaggcaacagtgctcaggaacacagatccattctagggt

SEQ ID NO: 2912 - DNA, 201 bp, Homo sapiens
tttatatttccatttttcctatttttctatttcaactatagtaactgtttaataatcaaaaacataggaggaatagacagaaataaaaattgttgtacttrgactacgtgttgacaaaccacagcctgtgggccaaatgcagcctgccctctgtttctgtggattaagagtattaggaaacagccttgcctgtttgtttgc

SEQ ID NO: 2913 - DNA, 201 bp, Homo sapiens
acatcaaggatgggggagggtttcagcaggaggcattggtgtccaggtcacaaagatgtccaggataagatcatggcttacttgccttgcaggcaccctcwtgatagttccctgtgacctcagttataagtttgtgtagtcatatatgtagtgttgggcaaaaaaactttttgtcactagttgtgttactgatttagtgag

SEQ ID NO: 2914 - DNA, 201 bp, Homo sapiens
cattcattcattcgacaaatagtaatttttcctttcttggctagggaatacagacctgtcccctgtcctgtgggagcttaaatctcatgaagaagacagayaaagataatataatgacccagataaaatgtaaacttgtggaaagtgtagggaaggagagagctgtgtttgctgtaagtgggtataaccaggggatttccc

SEQ ID NO: 2915 - DNA, 201 bp, Homo sapiens
tcttgaatggaacacttgctcttggagtcctgaggggccattgaaggtatccaactactctgaggctcccatgctggagagatcccaggtaagtgctccakttgagggtctcagctgaccccagtcttccagctgtccttgccaaggtgccagatgtatgagagcccctccagaccagaccatcttttagtccagtgccac

SEQ ID NO: 2916 - DNA, 201 bp, Homo sapiens
actgttggccttggtgatgactgcaccctgcttccttatatcattctttctacttttgtatatgtttgaaaacttccataataaagagtaaaatacaatcyagcaaaaactcaatacccgctagacaagagaatgtgtagctcttacaagtaataaaatgcactacagtaaaaaacaacatggaacaatatggatgaatct

SEQ ID NO: 2917 - DNA, 201 bp, Homo sapiens
tatgcaattcggtaatctaaaagttatctttgggcaatcttaactcattgtataaatccattattcttttaccaaatcctagaaatgagaagagacatcarattttttcctatgtgccaactatgtgtgccttacttacttcatctggttcactttatggtaaaacggagaggttacaatttatattttggaaataaatct

SEQ ID NO: 2918 - DNA, 201 bp, Homo sapiens
atatgtcagatgacagtaagtgatatggagaaaattaaggcagacggtatggggaggtgaaagttacagttctttagggtgttcagaggaggtctcataawgtttaataagggcaacatgaaagggaaggccaggaatagataaggaaatgagacatttgggtatttgggggggaaatatacctggtagaggggacagcat

SEQ ID NO: 2919 - DNA, 201 bp, Homo sapiens
tattcagttaggatatggtcacttaaataataaagaatggacgcagacaggaggatcataggacacggggtttaagttagaaagatctgcaaagcaggtaygacttggagtgggacttgaagggtgaatagcatgactttttcagtcacaggtctttcctggacatttactttttgttgttatatggaccctgacagctca

SEQ ID NO: 2920 - DNA, 201 bp, Homo sapiens
tcataatcccatcttcctagatgacccaaaggagtcatacagaaactcaaaaggttcaaaagcaaaatctttgaccctcttcactctttcataaacatgtytggaattcttactttaggtcaagcactggacactagaaatatcagtttaaataatccgtgagcactaccctcaaataatttatgctctatagcaatgtgg

SEQ ID NO: 2921 - DNA, 201 bp, Homo sapiens
ctttatgatgagaatatactatatgatacatacaacaattgattaaggttataggtaaggcgtctactcaacagtaatctattagtagttaagttttgggraagtcaaaagacttattcatgtatttctgactgtgtagggatgggggtggtattcctaaccctcacattgttcaagggtcaactttatagggatgtagat

SEQ ID NO: 2922 - DNA, 201 bp, Homo sapiens
ttgatagggattgtattgaatctgtagattgctttgggtagtatggacgttttaacaatactaattcttccaatccactaacatggaatacttttctttcyttttttctatcctcttcagtttctttcatcagtgttatgtgattttctctgtagagatctttcacttatttggttaagttaattcctatatatttaattt

SEQ ID NO: 2923 - DNA, 201 bp, Homo sapiens
ctgtattaagcactagttgttctttttaaaaaaaatggaattgtaaataaaagatacaagtacattttttgaagagataactggcacttgtccttaaattyttattaaaataactaaaatactctgcataagaaatgtctgtgattagcttatacttacattttataacttttattgcacaatggtccacagaatttaagt

SEQ ID NO: 2924 - DNA, 201 bp, Homo sapiens
tcctttatagatgaggaaaatcaagactccaagaggctaaacaagttgattattagtctcgtgcccagagaaaggagtccaagtttgtctgatttcaacaycaccagtcttttcatgcagacattctgccacccttgagtccttatcacaatgagacttctgtaatcctaaactcattaatagcacagattgtatcttgtt

SEQ ID NO: 2925 - DNA, 201 bp, Homo sapiens
gattaaattatgtcacgagtaaggcagaatacatgctttacttggcgaagcactgagcacagtgctaggcacattatagcaatttgtatacaaatatttgmccattgatcagaagtaaataagaaatgtattaaaatgagggaagtacatttactaacttctttgatgaccattctttgttttcatgagtgttctgttctg

SEQ ID NO: 2926 - DNA, 201 bp, Homo sapiens
acaagaccaaactaaaacccaaattagtagaatgaaagaaatagtaaagatcagagaataaataagcaaaatagagactgaaaaattataaaagatcaatraaacaaagagttggtttttgatcatataaaatgaataaaccattagctagactaagaaaaacacagagaaaaatccaaataaataaaatctgagatgtaa

SEQ ID NO: 2927 - DNA, 201 bp, Homo sapiens
cctaatgcttatcccctctcccaataaaaagggatcaacaaatagccaggcacatttcaactagggtatttgaaggagagtgctggagtaaaacagatgastggtagggatcctgtagagcatagtgactcataatggatgcacagaaaagggaatgaaacactccaactttgcctcctggtctctgcaacctggatcagt

SEQ ID NO: 2928 - DNA, 201 bp, Homo sapiens
gaaaatgacaattgtgcgtcagaggaaagtgggagcttggaatgaagaaagtgtcgggataaatttagcttttgtctttcttctgatctcaatttggatawtgtttgcaagatgagccctgttcaaccctcaggatcaagaagattgtgaaaggggtgggaaacagcacaggtgcactggacagtgaacaatcagatacaa

SEQ ID NO: 2929 - DNA, 201 bp, Homo sapiens
gctccaaaagaaattcatcgatttacaattttcttattattttgttaggaaacgaacatctcattttttaaatttgcatctcacattagtactacaaaaawttgatcactattaaaaattgttttcttacagaaacttctatgatctatacaggtcagggtagtgtaaatcaagtaatggtgtattgaaaaggttgcaagg

SEQ ID NO: 2930 - DNA, 201 bp, Homo sapiens
attatttacttatctggtttcaagtcttctggatatgggtcaggcagtatcgtgtccagatacagtgtttttcctaatatgagttttagaaatacatttayagattactggagattttgttaatttgctttggttagatgcaagattgtaacttaatggctgtaatgttacagaacagtcacttcaagtcaaaggaagggc

SEQ ID NO: 2931 - DNA, 201 bp, Homo sapiens
caacaacaataataaaacctcacaaagcttctacaaagaaacagtaataataataataataataataatagcaccagaaatacccaactttgataagcagkcatgttttagtcctcagtttttcttctccttgcaatttctcaaaagataatgcccagaaatttaggcttcttgtcagggtcctgcccccagtgaaaaata

SEQ ID NO: 2932 - DNA, 201 bp, Homo sapiens
gcttcagtcatgctaatccctccagtccaggtataaacttgtcttcttccaccacctagccaaaccctataattcagtcaagaaccagttcaaataactcytcctcatacacctgcatgcggaacattccaacccaatggaagtgcgtcctcttttgattcaggagcagctgtggtgcgttagaaggagcactgtcctgaa

SEQ ID NO: 2933 - DNA, 201 bp, Homo sapiens
cttagaaatcaaggaagtggaaagtttccaggaggagaatgtggttgccatttcaaatgcaacaaagaggcccagaaagataaggactgaaatgtatcccrtgggtttgataatctggaagtctggagactttggtaaacagttacagtggcgtggtagggacagaaccagggtactgtggtggggaatgatagagcaacg

SEQ ID NO: 2934 - DNA, 201 bp, Homo sapiens
agagaacacagatgaacaatgcaaagagatcaggaaaaccattcaggatataaacaagaaattcaccaatatcataaacaaaataaaacaaaaaaacagawattttggaactaaagaattaaatgagagaaaatatttgttcaagagcatcaataatagactagagcaagtagaagagtctcagaacttgaagacaggtct

SEQ ID NO: 2935 - DNA, 201 bp, Homo sapiens
gtagctgtagcttggcaccattttgagagctcagtccttaccagactgcatcccgccctgggacccaacagcccctacatttacacatttctagggacacrctaacattcccactgcattcacgaagaggactgcatcagcacaatgccagctggactcagtggagcagcagcgtccccagcattctagcacacacagtgt

SEQ ID NO: 2936 - DNA, 201 bp, Homo sapiens
atttgagggccatttgggcagtggctgttggccacgagaaccatcaccaatgtggcatctcctgggctgtgcagggtcacctggtgccatcgcaggacctkctggtcacatcagagcttcctgctgcaagtggggccgggagcctgggcctctgatgcccacatggacccatccaggacttggcccacccactgagcaaac

SEQ ID NO: 2937 - DNA, 201 bp, Homo sapiens
cccatggcttctttttcactgttgtccctaattatggtctttctcattaaaataacaaggaccatttctgctagaaacgctgacacatgtttttacttttstgggccgatggaaaccacatgtagaatccattccttccttttttccctccaaaatgcaaatggaagagctggtccagggggtccccggttgcccagccct

SEQ ID NO: 2938 - DNA, 201 bp, Homo sapiens
agccttcctgaactcatcccctcactctctctcccaatctcagcctgtgcatttaggtcctgccctggaatatggtaagatggaagactttcataatttcygatgcactgcactgaatctgggatttgtagcctatactagcatcctttctttaatttaaacgattagcgtttcaaatgtaaccaggaactgggcaccacg

SEQ ID NO: 2939 - DNA, 201 bp, Homo sapiens
taaacctattttgtaagtgaattaggtcttaggagagaatcagaaacgatgttgttcttttagccgcttacagtgtttgctttaaacccttgataggaacrtgggcttgtgacagcagcggcagaggtaaacagatgactttatatataatgctttttacaaggtggttcagttcgtttctaaccttggtctcggcgtcat

SEQ ID NO: 2940 - DNA, 201 bp, Homo sapiens
tcaaaatctattttttattggctgaaatgcgtaaaatgcaaaaacccacctcatacacaagcgcacccatttttcttttagtttttagtactgcaacaagmacatgccctacaaacacagaaattgtgatatgttttgtttcacttgtttcccataaaaactgtacggtgcatttatgattgtatatgttgggaaattctg

SEQ ID NO: 2941 - DNA, 201 bp, Homo sapiens
aagcagtcaattctgtagcagacgccaacggggtatcctccaatttaattttgacactgtctacttgaagatagcgtcagaatccacaggttgagggctcrgtctcacaaggctgcccctccttcagatgatagtctcaagtctaggcctctgaatgtctggcccaccagcttcaagttggggttccacaatacctccctt

SEQ ID NO: 2942 - DNA, 201 bp, Homo sapiens
ctaaaaaaaattgaggttttcttacaaaaaaaggggattttgaatagacaaaaataatgaacatcttttaaaacatgattattcagtttagaggtggcacraaactgagagatgtagctattaataatattgacaggaagaaggttcaaaagatttcaataagctactggagtgggcttaaactaacacaattaaatttaa

SEQ ID NO: 2943 - DNA, 201 bp, Homo sapiens
attgacaggaagaaggttcaaaagatttcaataagctactggagtgggcttaaactaacacaattaaatttaatcagaatagaaggaaagtttaacattgrcatcaaaatctcagttacataagtaatgttggggctattacttcaatgccaaagcatgaaagttttagttgtctacaaattcaattatttattaaccacc

SEQ ID NO: 2944 - DNA, 201 bp, Homo sapiens
ctacaaagaggtagcatgagaaactttttcgaggtgatggaacttttctgaatcttgattgtggtgttggttatattaatctatatatgtattaaaactcrtattactatataccaaaagaaaaaaagtaaaagtcaattttactgcatgataatttttaaaattgaattgaatttaaaaagttaaaatttataaaaattt

SEQ ID NO: 2945 - DNA, 201 bp, Homo sapiens
aggcattcttatatattttaaacctgaagctggtgtaatcaccaatcatttttagtgtttctgtgttccacacacattctaatcttgaaattctcaacacyaccataattagtaccacattcagactatgagactgggataaactggcgttatttcagatatctcttaaattgctctctaaccaacaagactcttagaacg

SEQ ID NO: 2946 - DNA, 201 bp, Homo sapiens
gtggaattcaccatgtagttgcatacagcaatattttatttattcttttgctgaatattattccattacttttgccagtttgaatggatttctttcttacrgtcaagtaggccatgactaagggagataatgaagcatggaattgtcttttccagagaaaccacaggcatggaataagaattccctgaggaggccttttct

SEQ ID NO: 2947 - DNA, 201 bp, Homo sapiens
acagtcctgccactgctctccagcccaggcaacagagtgagacactatctcaaaaaaattaagttgaaaacaattttaacattttaatatgtgagcatccmtttctatgactgctgaattttattctaagaatagataaaaagttaatttcaagtatcgaaaacttgccactttcttttttcatgtttggattacaggcct

SEQ ID NO: 2948 - DNA, 201 bp, Homo sapiens
aaacaactccaactattttttctctgctctcacaccaatcaacacagaagacatctgtgaccaaatgtgtatgggtttttctccacacaccaagcaagcartcaattctgtagcagacgccaacggggtatcctccaatttaattttgacactgtctacttgaagatagcgtcagaatccacaggttgagggctcggtctc

SEQ ID NO: 2949 - DNA, 201 bp, Homo sapiens
gagagactaaaaaggagcatttgcagtagtgagaaaaccaggcaaagaggagttgaggagttaggaaactaaaccagcgtactaaacagaaggagtggtcygaagtgtcaaacgctgttgattgtggcagaataaacagcagtggtgaaatgaagacaggaggtaggttataggtgagagaggagtgaagtgctaatgtct

SEQ ID NO: 2950 - DNA, 201 bp, Homo sapiens
tgattgcaggactcttggcagtactagtgtgagttgaaacaatgaatgaatttgccagatctgatcaacagtttcaaggaagagtggactcactaatcttygagatctgggaaaaccttgagtggggccttcgtgttcctatctttctgagttgaagaaggaactcatccttcatctccaagtcaatggtaccagtggctt

SEQ ID NO: 2951 - DNA, 201 bp, Homo sapiens
tctcttgataaattagaagatctggcaacactggcccacattgtcatatagtagtttacccaagctgactagcagctactgccttgaaattaggcattgaraggatgagcatgtgggctgtggtcacagactggctgggattctacccaagctgcaccacttactaactgtgtaacttgaggcgaccttttgaccctcaat

SEQ ID NO: 2952 - DNA, 201 bp, Homo sapiens
atcatcggtgaaggcccaggctggatgtcaggcatcagtatcggacttagacagggctaaagggagagatggcgataccaagctcaatcagatctacagcycccgagaattctctcctcccaccccctgtccctcacacctgggtgacaggtgtttaccaggagcatggaaatgagatccatgctctgggaagaggtatag

SEQ ID NO: 2953 - DNA, 201 bp, Homo sapiens
tcagaatgagagagggaattctatggtacactttcctcttaccccattacctgaatgagtcatttcctgccatgtcactctacaaggaggtggcatcatcrgtgaaggcccaggctggatgtcaggcatcagtatcggacttagacagggctaaagggagagatggcgataccaagctcaatcagatctacagctcccgag

SEQ ID NO: 2954 - DNA, 201 bp, Homo sapiens
ccattctttatttgatcaacacaagctttggcatgctttaaaggagcagtagttaaggcagttatgctggaatttctttagaagtggagatggcgttttcrttacccagacgggtgttataattaatgagaacaaataccactggggtaaaattatgatgagactaaaattttaaattctgttggcattttaatattaata

SEQ ID NO: 2955 - DNA, 201 bp, Homo sapiens
gaaattaaatatacataaaaagcaaccacactgtatttttttggaaaaaaaaatttgtttttcatacaattgtatgtttgagtaagaaaaaaatcattcamctcctatctttgatttattatttttatttgcatggtttacactctgttcaagcaaggattccctatctggacaccacaagctacctataaactgatattc

SEQ ID NO: 2956 - DNA, 201 bp, Homo sapiens
acaagaagacagaaaaagctcaggcttcagacatttgcaagctgcagctgtttttcatggcaggagattctgaagacttatgagctgacacattaccctcracattaccatgcattgacctctctgctccttcttctccctggagtggtgttcaaggctactgtttgacacaagggccaccaaagaccatatcaaagcagt

SEQ ID NO: 2957 - DNA, 201 bp, Homo sapiens
actattaactatagtcactatgttgtacaatagatctcttgaagttattcctaagattactcctaattgctaagagagtagtttttaggttttctcaccawgaaaaatgacaagtttgtgaagtaaggtctatgttaattaacttgattgagccattttacagtgtacgcatatatcaaaacatcatattgcacaggtaaa

SEQ ID NO: 2958 - DNA, 201 bp, Homo sapiens
tgaccattctttttttgtcattccgaaatttaaccacaatatgtgaatagctatatcttttacaattcattctgctcaacagaccttcttatcctgatgaygtatgacctctttaatcctgagaaattttctctcattgttttgagaatttcaggctatatgtttaagattcttgcagcttcattcaggtttacttaataa

SEQ ID NO: 2959 - DNA, 201 bp, Homo sapiens
acactaggatctttgaccattctttttttgtcattccgaaatttaaccacaatatgtgaatagctatatcttttacaattcattctgctcaacagaccttyttatcctgatgatgtatgacctctttaatcctgagaaattttctctcattgttttgagaatttcaggctatatgtttaagattcttgcagcttcattcag

SEQ ID NO: 2960 - DNA, 201 bp, Homo sapiens
gtgcttctaattagattctttttaagagtttccatctctctgcttatattacctatctcttcctgcatgttgtctcctttgtccattagcggccttagccyattaattataattactttgaatttcaggtctgataattccaggattatctgattcatatccgaatctggttgtgatgattgcttcattgctgcctctctt

SEQ ID NO: 2961 - DNA, 201 bp, Homo sapiens
ctcctcccctattgcatctattcaactttccccctgcctctgaaagccctagatctcttgaccgtctctatcattttgccttctttagaatgccaaagaartggaatcatataccacagagacttttcagaccagcttaatcactgaacaacatgcatttaagactcattcatgtctttttgtggctcagtcctttttatc

SEQ ID NO: 2962 - DNA, 201 bp, Homo sapiens
tacaaaatactttccctgccctaaaatttcccccatatctcctcccctattgcatctattcaactttccccctgcctctgaaagccctagatctcttgacygtctctatcattttgccttctttagaatgccaaagaaatggaatcatataccacagagacttttcagaccagcttaatcactgaacaacatgcatttaag

SEQ ID NO: 2963 - DNA, 201 bp, Homo sapiens
atagaacattggcagatatgagatgagcaaaggcttcagacatgcttgtttagttggcttctttctcttgtgttcctgacattgccatgagaagagcataygctgggtaaccagggctccaaatgagccagattgatccaagctgccccagctgacttgcaaacctgaaactaaagcagaatcatctcagccaaccttcag

SEQ ID NO: 2964 - DNA, 201 bp, Homo sapiens
tatgcagttcacctgccaaggaaaagcccaaggtgctatgtattcttctctttaggatttaggattatcatttatgtgctgttacacagtgaaaccttgcytgtgtgtatgtgaaagctggttggcattgttttcaattcagtttttggatggctaacttgattgtttttactgtgctgctggaatgcctctgtatctttc

SEQ ID NO: 2965 - DNA, 201 bp, Homo sapiens
ctgtgtgttcttaaagtacattttacaaaacatgaatagagctacaccaacaaatattttcttaatgattatatgcatggtatactctttacatctttggytttcatttgtgtgtgtgcatgtgggtgcgttctcatatattagaaatctctcccaaaaacagtagattattgttttctaattattctttaaaaatccaga

SEQ ID NO: 2966 - DNA, 201 bp, Homo sapiens
agcagaagtggatctagttacagtttttcacgtaaggacaaaacaagaagacagaaaaagctcaggcttcagacatttgcaagctgcagctgtttttcatsgcaggagattctgaagacttatgagctgacacattaccctcgacattaccatgcattgacctctctgctccttcttctccctggagtggtgttcaaggct

SEQ ID NO: 2967 - DNA, 201 bp, Homo sapiens
ggatctagaaacatttatagagagttcctaaatacccggtttccactattactaataccttacatgactatggtagacactggagtaagacctaaaaacaycaaagaatctcctacttgaaacaaagatatatgatctgtaattaaggctttttgatttttcaccccagttttctttattttctctgctaaatacattttc

SEQ ID NO: 2968 - DNA, 201 bp, Homo sapiens
gggtacttcagttggaaatgcagaaataacccctcttctgcattggtctctctgggagctgcaggccagagctgttcctatttggcctttttgcccaggastttttcataagtttttaattgaaataaaacatatgtgacgaacaatacaaaaatcattagtgtacactttgatggattttacagctcactggtataatca

SEQ ID NO: 2969 - DNA, 201 bp, Homo sapiens
ggcaagtcaccaaactagactagacacaagtagagtggggtgtgtcaggggttggggggaagcagagtaagtgaaaagagattccatttcctataggaaaragttccaaagtcatattgcaaaggcatgaagcattggagacatttttgcagacaaactaccacacttttttaagatgaaccagaataggtcagattatct

SEQ ID NO: 2970 - DNA, 201 bp, Homo sapiens
atacattgttagaaaactttgctaatgttttgctgaagaattttgcatcaaagttcatgaaagatgttgttctgcagtttttctatatcataatgtctgtrtcttgttttagtttcagggtaatacttctataatagaatgagttaggaagtgtttctgctgcttctatttttagaagtaattgtggagaattcatattat

SEQ ID NO: 2971 - DNA, 201 bp, Homo sapiens
atgatgcaaaaatataactttatacaaaagttatatttttgaattaaaatatttattcttattctactgtattctgaatattaggctttcaatttatttawttctgcattaccccagtccagaacatactattctttgttctggatattaggcaatggcttttgagcagaagaaataaagattaactttgaccttgatata

SEQ ID NO: 2972 - DNA, 201 bp, Homo sapiens
tgattgattcagaactataacaggtataaaactcagtcagaagagtgaaagtaagaggcaggcttatttggagagaatgtgagattaatctattttaaaaygagtattactgaaaaactagaatctgataacttgagatataaaaatttgttatcattggaaatattcagccacgaaataactgaatgcatatctactggg

SEQ ID NO: 2973 - DNA, 201 bp, Homo sapiens
tttttattaattttatgagagtttttaaaatattatgaatgggtattggattttgtaaaaagctttcctggtatcaattaatctagcatatatttttttcytctttagcatgtttatatagttgaataaattgatttgttttcaaatgttgaaccagccttacatacttgaaataatcccatttaatcattctgtataatt

SEQ ID NO: 2974 - DNA, 201 bp, Homo sapiens
atgaaagagaacaaggaaattaagatggttggatcaccagattacttcctccatggatgggaatgacattggagagctggaatttgtttcagtcacggaaytgataacataattgctaggttttagatactggaatgacacacaattatattatagcccaaacacatccttgataattttaatgtttaaaagactcagctt

SEQ ID NO: 2975 - DNA, 201 bp, Homo sapiens
ctgactagaactagacatatggccaattctttgcaagggaagttggtagaacagtatttcttgtacccaggaaagagataactgcatataggtgggcactwgcagtatctaccacaaaaaaagattcaataaacttttactgcttttttaacattcatgttctactggtgagatgggaaatgaatacattattagtggaga

SEQ ID NO: 2976 - DNA, 201 bp, Homo sapiens
agtcatcttttatcaccagctgctatacaaatgtctttaacttaatgagtcaataagccaaaataaggtatttcagcctcttcataacatttgagcaacartactcaaagtgtggacagactgtggaccagaagcttcagtattacttgggggcttgttagaaaggttagaatatcagaccctaaaccagtcctgctgaat

SEQ ID NO: 2977 - DNA, 201 bp, Homo sapiens
cacccgaaggctcaacaccatgtggaacctaccaagacttggggcttgcaccctctgaagcaatagcccaagctgtactttggccccttttattcatgacyagagtggctaggattcagggcaccaagtctctagtctgcacacagtggagggaccatgggcctgacccaatatttaagacgtttattcctcctaaacctc

SEQ ID NO: 2978 - DNA, 201 bp, Homo sapiens
atgaagtagaagtaaggtctgcaggctggagtttcatccagagaaatcttcttggctgtgaatcagtacaggagcataaggtggggacagtgagggatagyagtaggaatggcaacagaaacaaaaagaggagaaagggtagcttctaggaattgcttaaagagcacaagaagaatgtggaagttaataaaaggaaactat

SEQ ID NO: 2979 - DNA, 201 bp, Homo sapiens
aatgaaactttgaatcacctgggaagcatattagactacagatgctcagcccgagctactgagattcagagttttcaggaggcagggccctggccactggyacataaatgactctccatgtgactctaatgaaccacagagtttgagaaccactgtaactaggcaactaggaacgtaggaaccaagataagattgtgcctc

SEQ ID NO: 2980 - DNA, 201 bp, Homo sapiens
gaagaagaaagattcaggatataatgtgatacagtttcctgctacccagcagtgcatgcaaatttttcatatgctgataggagaattgtggagtgattcasaggagatcaaactaataagtggcccagcctatatgcccttatgatctgggtgtggtgagataatggaaacctaggtagaaagaaaactccaaacgtctta

SEQ ID NO: 2981 - DNA, 201 bp, Homo sapiens
agttggcgtatctctcctcccatttcattcaggtatcacatagtttttgtagtacactgaagcagattattatacagggataagcatttgggagttccaargaaacgtgagagcatatgcaattgtaggaagctgaggaggaaaatggcccaaattaagaccatccagttatccccagtcatgagagcacagagtttattt

SEQ ID NO: 2982 - DNA, 201 bp, Homo sapiens
acgctacatttgaagaactaatattaatcctactgaaactattctgcaaaatagaggaggagcgaattcttccaaactcattccacaaggccaatattacmctgatacgaaaaccaaacaaagacacattaaaaatagcaactacaggccaatatccatgataaatactgatgcaaaaatcctcaacaaaatagcggcaaa

SEQ ID NO: 2983 - DNA, 201 bp, Homo sapiens
attttttccccaacgtaatccagatctccctttagaagacgctgggaatttacacgagaaatggggcaggccatgagcaaaacaaaaaaatgactgatatycttcttcggctttcatgaatttttcttttagctttggcccccacctctactactgatcaaaattccagggcttataaagtgctggtgctcagctaggatt

SEQ ID NO: 2984 - DNA, 201 bp, Homo sapiens
tctttctctttggcttcacctaattctcctcacctgttttcagcagtgaggaagctctttattttacccagagtcactgtttcccccagccctctttgtamtagagaatctggatacctccacctgcagcctgccaccctgcatactctgatactatgtgtcttggaagctttgccctgaggaaccatccagagaaagttc

SEQ ID NO: 2985 - DNA, 201 bp, Homo sapiens
ctgagcaaaaacaaagggtagggggtgttgagaaaaacttcttaaatgttttgttgcagccagcactggtgccttctggatactagggataccagggtcaytcagggatatctaactttctgttcatttctgagaaacaaacttcccctggattccttctttctctttggcttcacctaattctcctcacctgttttcagc

SEQ ID NO: 2986 - DNA, 201 bp, Homo sapiens
taatcatccacatttgtaaaggtcttggcactttgaaatgccttcacaatgcactttattccattaatccctcccagtgacattattatgtcatcaaataygttattcaggattgcacaaacaacacgtggcgggaagaaaacacggtttttcttttctatgtccagtgttcttactcagaccttcccaccttcccctttc

SEQ ID NO: 2987 - DNA, 201 bp, Homo sapiens
acaattttaaaggtcaagtgagctcttccgtagcagctcttcaaatggcatgtagatttcactggccacagcccagctcccccagcctaaaccaggcccayagcatacttgagccaccctggggatagctgccctgagggctcagagtaaacaggtaaacagctgtgccatgcttttcagtgcaagggacctaggtgagca

SEQ ID NO: 2988 - DNA, 201 bp, Homo sapiens
gaatctacaaaaaaaaaaaaaaagaggcagaataggccatgatggaaaaggccatactctttctgaataggagagagaagtgcctgggaatgatacagggrgaagagagagggaattgaaatagcagtcatggctagtaaagctgcatgtataaatggttctttggtatccttttagaaatctagtacctactggcggcta

SEQ ID NO: 2989 - DNA, 201 bp, Homo sapiens
cttggtcactttctacagtctccacccagttttgaaatactgagaatttcaagaattaagatgagcgaactttctaatctgccagtgtgaacataactaarccagcttccctgggaaaaccacaacttctgaagaagccacatctgaatgctggggtccatcaaatgcacgtcttgcatttgaaaatcaagggtatccccc

SEQ ID NO: 2990 - DNA, 201 bp, Homo sapiens
caggaacacaccagaatgtttagaggtgatggacatgctttgtcttttgattgtggtgatggcatcacaggtgcatacatatgtccaaatttatcaaaatrtataagttaaatatgtgcaatttttatcaattatacttcaaaaaacttctaaaaagtatagttaaagaatcaacttttcctgtaggaaggggaggaaagg

SEQ ID NO: 2991 - DNA, 201 bp, Homo sapiens
gtcaaagtgagaaataggagatttggcaatggaactagaaattggagtgatgggaagaaggggtcaatgagctgaggattataggcaacctagaggctggraaatggaaggaatgggagattccaagaggaaatgtccctgctgaaaccttgactttacaccagtgagactaatttccagaagtgaaagtttactttgctg

SEQ ID NO: 2992 - DNA, 201 bp, Homo sapiens
taatcatcccaaggcaaaataccaggcaactagagaccacccttagagctcaaagaaagcagaaatcattcaaactagccagtccttactgttcatcttaycctgtcctgtcttgcctcaataaaatcagtgacctaaaccttcctatcactcctgtgtcctgcctcctgaccaccttggtgtccttcccttgttgccttg

SEQ ID NO: 2993 - DNA, 201 bp, Homo sapiens
gcaactagagaccacccttagagctcaaagaaagcagaaatcattcaaactagccagtccttactgttcatcttaccctgtcctgtcttgcctcaataaawtcagtgacctaaaccttcctatcactcctgtgtcctgcctcctgaccaccttggtgtccttcccttgttgccttgtgtgacacgccatgtctcctgtttc

SEQ ID NO: 2994 - DNA, 201 bp, Homo sapiens
tcccaaagtgctgggattacaggcgtcatccactgcgcctggcccacaagagttcttatacgagagagacagggtagtcaaagtgagaaataggagatttrgcaatggaactagaaattggagtgatgggaagaaggggtcaatgagctgaggattataggcaacctagaggctgggaaatggaaggaatgggagattcca

SEQ ID NO: 2995 - DNA, 201 bp, Homo sapiens
gaaaggctgtaagcttcgatggagagctcaacgttagaaagtgaaaagtcagcatttaaaattttccacctaaggtgttagcagagaacttaaagttttcyaagatcgacttaaataataccttatattctttaatcttaaagctgatttggcaaaagtcaacttcagagtctgattctgtttattactcaattataacac

SEQ ID NO: 2996 - DNA, 201 bp, Homo sapiens
tctttaatcttaaagctgatttggcaaaagtcaacttcagagtctgattctgtttattactcaattataacacaaattgaattcattatgttagataaatyatcagagaagaaggagacattagaattaaaatagtgatttgggaatattgagatgacatattaaatcttaccaagccagccggcagaaacagaccatctt

SEQ ID NO: 2997 - DNA, 201 bp, Homo sapiens
tcccatgatacctggattaggaactgaatcatagagacaggcttggtggaatgtatccactttgttggacaagaccatggaagatgtggcatcatcagcakctttgcattcatcagctcactgtagcagcagcagcagttttaccaaacatggcccacacagtgtggtttaacagtcaggaggaggagcagcagctacctg

SEQ ID NO: 2998 - DNA, 201 bp, Homo sapiens; identical to SEQ ID NO: 1463

SEQ ID NO: 2999 - DNA, 201 bp, Homo sapiens
acacctaccagctatcattgctcccagacctttaaccaggtcatcaggctccagggagcaattaaaattcaagcctagagagaaaagttattggcaacagkaaaattgcaaattctttctttcctagtttatctcagagaaaaacaaaactaaactaaacaaaaaaagatagaaagctggaatgtgatataagatcagaag

SEQ ID NO: 3000 - DNA, 201 bp, Homo sapiens
ttttctgatatcttacttttttttttccagtggagcaaggctctcagtggagagtgaagatggaaaaggaaatagtgaaaatttgaaggcaaaaaagataygaacgagtcatccaggagagtgagagatgagaaaaatggacaagagaaatataagagactttctggcagcagcaagggtcatgaaaaagttagatgactc

SEQ ID NO: 3001 - DNA, 201 bp, Homo sapiens
ctaagtcttgtgcgttgggccctttcttatctgctcaaggttccaatgcacttcccaccaagcttccatgtgagccagctttatcttcagtctcatttttstgtagagttaccaaagctgtctatatctgcagacatatttagtcgggtggccttctgttttccagtgttccttcctaataaatctctctgcctaaagaac

SEQ ID NO: 3002 - DNA, 201 bp, Homo sapiens
acaaaacctgagggactgtgctggccaggagaatcttgaaacaactggtacaaaaagaaagagttttatttggaagagttttttaagaagtgatatatggsaagctatatttagcaagaaatctcaatcctaatattgattctgcttagccaaacttactggaaggtaaatgccaggtcctccagagagagcacaagcttt

SEQ ID NO: 3003 - DNA, 201 bp, Homo sapiens; identical to SEQ ID NO: 751

SEQ ID NO: 3004 - DNA, 201 bp, Homo sapiens; identical to SEQ ID NO: 761

SEQ ID NO: 3005 - DNA, 201 bp, Homo sapiens
ctttttggaaaactttgcaggtagtttcaatgcttaaccaaagttaagaacaatggaaatctgtcagcttttgtgcctgtaaggtttatttggcctgagtygtgagaccccatggagctcctgcagcctgtgtggaatcaggggagggaggagtggacacaaacaatatttgcacagtactaggcaccctttgtgtgctca

SEQ ID NO: 3006 - DNA, 201 bp, Homo sapiens
ggatctacaagggacttctgatgacttagagaccccttggggaacgcaaagaaaggtgccacgcgccccgcttttgtcttccttatggggcctgaggagtmgtgggtagcttcctctcgggtctaaagcttggctgtctttggcactgtgtcactggatctctttggctttgggggtaccagggattacgttgcactgtga

SEQ ID NO: 3007 - DNA, 201 bp, Homo sapiens
aatgatgggatgcttgttgagtgagaccttgacagaagctatcataagctaggacctatgtctgctagtcatttaaattatttctatggtaacaaatgacrggtagtgagatcaatacttctactttgatcatactgatttttttttttttttttggtttgtgtaatctggaaaggagacaataagatgtttaagactggg

SEQ ID NO: 3008 - DNA, 201 bp, Homo sapiens
tcctgttaccttgaacatccaattattttgcattcttttgattttgcacttcctaaatatgtcttgaattcttccatttctccccttctccctaaaatacyatatctcacctagattctaataagtagaacagcctcctatttattatgctccaaacttgaccgaactcaaagtattcacactgcagtgatcttccttaaa

SEQ ID NO: 3009 - DNA, 201 bp, Homo sapiens
tccatttcttccacactcagatcctcctggagagctctagaggcctcccctccctaccatattgaaaattctgttctctccttgctactgctccagattcrtataccccagttcatctatatacatagaaaaatataaaagaacctctgtttactctgatgttccatgatgcaggtagcaattcggtggttgtctctttct

SEQ ID NO: 3010 - DNA, 201 bp, Homo sapiens
ctgtggaaaaaatctggactcattcacagcctaaaacgagtccgtctaaccccaaccgaccctagtcaagcccaacagggtcacagctgactctcagatgygaaagcaggaaataaatgtttattattataaaccactgagattaaagggtggctttttacatagtataatcagaatgataataagtaatatattcccaga

SEQ ID NO: 3011 - DNA, 201 bp, Homo sapiens
tttcccctgtggcctccctctgggtagaaaagacttctcaattctattgactttgaacttgcccatgtgatttcatttggctaacgaactgtaagtggatrtggcttgaacagaggtcttaaatgtgcttgcatgtattgctttggcctctagaggtacggaattttatgagttcagaatgaaactgtcatgtttccagaa

SEQ ID NO: 3012 - DNA, 201 bp, Homo sapiens
taccaaaatttgtgcttctgtttttcaaaaacagtccttctctctttttatctcttttcccaaaatcagaccctgggggatatattaggtcaggccctccrcaagtaatacagggtcttctcttaactgtggatcgtggtcattttagtgaagttgttcagagaccattccatccccactgcagagggaaagaatgagaat

SEQ ID NO: 3013 - DNA, 201 bp, Homo sapiens
aatcagaccctgggggatatattaggtcaggccctccgcaagtaatacagggtcttctcttaactgtggatcgtggtcattttagtgaagttgttcagagrccattccatccccactgcagagggaaagaatgagaattcttgggagtgaatgcacgtgggttagaagaattggaaagctggaatgagtttgttgcttcag

SEQ ID NO: 3014 - DNA, 201 bp, Homo sapiens
agatggcaggctccatctcagacccagaaaagtctttgattttcaccagcaccagcagtgaaacagcagggccacagccagaagaggaatgctgagcagcyccgccgtgtctcttgcagcgataaggccatctctgttgcctagagtctccaaggaaaaataacctgtgtgagcctcagcagagaggtacagaactcggaa

SEQ ID NO: 3015 - DNA, 201 bp, Homo sapiens
tcagacccagaaaagtctttgattttcaccagcaccagcagtgaaacagcagggccacagccagaagaggaatgctgagcagctccgccgtgtctcttgcrgcgataaggccatctctgttgcctagagtctccaaggaaaaataacctgtgtgagcctcagcagagaggtacagaactcggaattgccttttccttagct

SEQ ID NO: 3016 - DNA, 201 bp, Homo sapiens
gacccagaaaagtctttgattttcaccagcaccagcagtgaaacagcagggccacagccagaagaggaatgctgagcagctccgccgtgtctcttgcagcrataaggccatctctgttgcctagagtctccaaggaaaaataacctgtgtgagcctcagcagagaggtacagaactcggaattgccttttccttagctttg

SEQ ID NO: 3017 - DNA, 201 bp, Homo sapiens
cagctccgccgtgtctcttgcagcgataaggccatctctgttgcctagagtctccaaggaaaaataacctgtgtgagcctcagcagagaggtacagaactyggaattgccttttccttagctttgttgggtcctgagccatgggagaggaggaagctaagggcctaggactcatgaggacatcctggtccaggttatggcc

SEQ ID NO: 3018 - DNA, 201 bp, Homo sapiens
aagttggtagtatagttccagtccaaatctgatgatctgagtaccagaagcagcaatggtgtaagttctagtccaagtccaaaggcctgagaaccaagagkgctgatgctataaatcccagtccagggcaggagaacatggatgtcgcagcacagcagtcaggcaaagagagagaattctcccttcctcagctttttgttc

SEQ ID NO: 3019 - DNA, 201 bp, Homo sapiens
catctgcaaggcacttattaggcaattggcacacacatagaaaatcaattttagactatttttaaaacccttttagaaacaataaagcaatattgtgagckaatactatcactaataatagtttaatgtgatgaagagtaagttttttttcagcaaatttttcagagcaattatgtatgatgtaatcctgaatagcttgga

SEQ ID NO: 3020 - DNA, 201 bp, Homo sapiens
tttttgatgattccagcatctgcaaggcacttattaggcaattggcacacacatagaaaatcaattttagactatttttaaaacccttttagaaacaataragcaatattgtgagctaatactatcactaataatagtttaatgtgatgaagagtaagttttttttcagcaaatttttcagagcaattatgtatgatgtaa

SEQ ID NO: 3021 - DNA, 201 bp, Homo sapiens
ggtatttaaatctaaagccgtgattggattcagttttaatatttggggcatggatgctttgtaggtggtattgtatgcttccatcaggagacctataatgyttgactgtcaattttttatgttaacttaaccagtaggtgtatcatgaaacatccatacaaaacagtggtttcctatttctttcattccatcttcatttat

SEQ ID NO: 3022 - DNA, 201 bp, Homo sapiens
attttaaaaatacaactttcaatagctacaaaaatataatatatatttgcaagtttaacaaaatatatgggggatctgtatgttgaaaactataaaatgcygattagaatttgttgtggatattgacaagttgattctaaaatttatatacaaaagcaaagaaagtagaagccaaaataaattttttaatgaataaaaatg

SEQ ID NO: 3023 - DNA, 201 bp, Homo sapiens
cctcttttcttgtattttttagcctctacagattgcccacatatttgggatcatggctcctttcctccagtttcaaagccagcaacaatgcatctctctgycattcttctgtggtcacatctccctctaatcacagctggaaaagattgtttgctttgagggaggcttgtgatttgattgagcccacctagataatccagg

SEQ ID NO: 3024 - DNA, 201 bp, Homo sapiens
aaccccaacttagtgcctttaaatgttctggatcctctaaattcctttccacattgctgttaatctcacattctcttttatcatgattatttcctaacttmtaggtctacttctctttggctgtacacctacttcttaaacctgacttgttattcagctcagtgtttttgatgattccagcatctgcaaggcacttattag

SEQ ID NO: 3025 - DNA, 201 bp, Homo sapiens
attaatacatttatataatttgtaaaggtcaaatcagtgtaactgggatatctatcaactgaaatatttgtcttttttatgttagaaacattcttattackttttcttcttctctttttctccctctctccttttttttctatttcttttttcttttgccatttatttgttaaagaaatcaggtcatttgtcctataacag

SEQ ID NO: 3026 - DNA, 201 bp, Homo sapiens
tgtaaatattatctttcttttttgtgtgggggggtacatgaggcaaattaatacatttatataatttgtaaaggtcaaatcagtgtaactgggatatctaycaactgaaatatttgtcttttttatgttagaaacattcttattactttttcttcttctctttttctccctctctccttttttttctatttcttttttctt

SEQ ID NO: 3027 - DNA, 201 bp, Homo sapiens
taacttgatttgtcaggatccaaacaaggtccacccattgcttttggctgatataactcaagtcccatttaatttgtaaatattatctttcttttttgtgkgggggggtacatgaggcaaattaatacatttatataatttgtaaaggtcaaatcagtgtaactgggatatctatcaactgaaatatttgtcttttttatg

SEQ ID NO: 3028 - DNA, 201 bp, Homo sapiens
tacatttaatctaatactttggtataagctctaaaaataggtatccttttagtttttataacagcatagctatgaaacattatcatttacatctaaaacaytcaataatttcttaatattagtgtacaaatttcctttagtgtttcatgagtgattttttttcttaacttgatttgtcaggatccaaacaaggtccaccca

SEQ ID NO: 3029 - DNA, 201 bp, Homo sapiens
ccactctcccgtcactggattatttcaaaccaagtcacatcatgtgaccgactaatttaatgtatatttaatctaaattaatacatttaatctaatacttyggtataagctctaaaaataggtatccttttagtttttataacagcatagctatgaaacattatcatttacatctaaaacattcaataatttcttaatatt

SEQ ID NO: 3030 - DNA, 201 bp, Homo sapiens
atggatttacttaaagatttttaatgtaatgagttcacaaatttttacgtccaaaacactgcacaagcaataataggttttataaattctattatatagasagaaggaaaaaatgagtaaattgagcaaggaaaatgaaaatacaacaacgaatgcagactccatgaaatgattacaagtttattaagattttaaatagaa

SEQ ID NO: 3031 - DNA, 201 bp, Homo sapiens
cattattcccaccaccacccagtggtttctgacccatgctttctgactacaagggaaagggcatgacaaatgtatacacaagtatatgtgtatgtgtataygtgtgtgttaatgcatatgtaagtgtgtttctatatatgcatttccaattatctttcttcttatctaatttaggtaaagaatcttgataaaaggatctta

SEQ ID NO: 3032 - DNA, 201 bp, Homo sapiens
gtgaattccctggatcccagatataatcatccttgcccctaccatggaggagcaatccaatttctctctgataattgcaatctatttcccctgccaatacratgatgctattctctgcctgtggattcaatggcagaaaaagcccagtgtgcacaggacatcagttatagcctccaatccatgggaactataactatgtta

SEQ ID NO: 3033 - DNA, 201 bp, Homo sapiens
gttttccatagaagatgcacaattttacattcctaccaacagtgcataagtgttccaatttctacacatccttgccaagagttattttgtggggttttttyaatagtagttattctaatgggtgtgaaatccaacaacattttaactcccccacacttccagtttgtgtaaagcagctgtttcaggaagcttctgaataag

SEQ ID NO: 3034 - DNA, 201 bp, Homo sapiens
aaataaacgatttgaagtatacagtcaaatggtatttaggacatttatatcttgcacaccatcaattctaaaacattttcttcaccccagaaggaaacctrgtaccccatagcagtaattccccatttcttcttccctgacccctggcaaccgctagtctgctttctgtccatatggatttacctactctagatattccat

SEQ ID NO: 3035 - DNA, 201 bp, Homo sapiens
aaattatctggtattggtttctttaaacaaaaggatttaattacttgaaaaagataagctttatctatttttaaatttttgctaataaaactcaaagaaaygaagaacaattcaagcctttcttgtggttttaaccatactttgttttgcagaagttcaaaatgattgatattatctgtcccagtcctattcagtgttagg

SEQ ID NO: 3036 - DNA, 201 bp, Homo sapiens
tcaagctttttctttagatggggtcacattccatctaagagacatcccaagacagatacccatgggaaatatacttccacgcaattctcttttgcatatcktctctctagagtgaatcaaattatcttttattctatggtgacaaactgtaaacagtgcaaaatagaacaaagtgggaggtggagagacagcacctgtaca

SEQ ID NO: 3037 - DNA, 201 bp, Homo sapiens
atggataataaagaatggaacagctcacatggtctggggctgtgggctcagcgccattaacatatgctctcctaacaggactgtaccaatgcatagtcacwgtcagcttttctgagcttcttgtttgcaccaagcacagctggaagtacagatgtaggaagcacaccggcaggctggaaaaggatcaagacaggtaccgat

SEQ ID NO: 3038 - DNA, 201 bp, Homo sapiens
tggaaaaaaaaacacttttttatgtgcaaaatttatttgtggccaagtacatgattaattttcgtatatatttcatggctagtaaagtatatttttggaasacataaaaagtctcctcttattaattgtactattttttgtgtagttacttaatattgtatacaagttatacatgcacaattcaaaaagaggtgtactgaa

SEQ ID NO: 3039 - DNA, 201 bp, Homo sapiens
tcattatttaatttcttcctcacattgaaaatagtactaatgaaatgcagatgatacaatttttcagccttatgaaggtgtgaaattgatatgcatttggyagaacccatacttagaatttttcaatttcgatcttttcctggactagcattatgaggtacagtactctctctctctctctttctctctctctctctcaaa

SEQ ID NO: 3040 - DNA, 201 bp, Homo sapiens
agttgagctaatgacctctggagttggcaggaaagagtcacatataagagactactttgagtaaagcattgagctttagtcaaaaattcagccagcaagargcaacttcagccagaagaataagtactcagacctcattcttccccctcctgctgatctgccagccatggctacctattggtcaaacccaaccagaaagtg

SEQ ID NO: 3041 - DNA, 201 bp, Homo sapiens
ttatcattacagttcatactatgttttactcgtttaaattttaaatacaaataaaaactctaagctatcctgtaaaatgatagaattgaaataactcgagytttttcccttgatctttacaatctctgtgtcatcactttatttttaacatattgtttaaatgcaggaatatgtactatcacaggatttagagacatgagc

SEQ ID NO: 3042 - DNA, 201 bp, Homo sapiens
gaagcaagtatttctaagcatattgttctattcttcttctccagatgaattatttttatgattaactaagtatattcatatatttattccttaaacaaatrtggtttagggatctacaatacagatcaaagctataaatgtgataaaccaaatataattctcctagataattcatatacaagggagggacaaaatttaaga

SEQ ID NO: 3043 - DNA, 201 bp, Homo sapiens
gtggcaggaaatttcagctgttaaacatccactccagcaatgccaagcatattaatcatcccaacaattcctaagtaggcattgttttccgtgcaacataygggatcatgcagaatctgaaatggaatttgcccaggcttacacagagagtgagaggatttgaatcaagatgggtcaaacaccaatacccagggcttgtac

SEQ ID NO: 3044 - DNA, 201 bp, Homo sapiens
agccatctccactttccaaagtaatttacattcattcatttgggattttctacatcgatttctataggatccaggaaggttaactagacctacagtgctgyaggggtaggaaagaaaactgatgtggggaactttttgcacttgtcaggactgattcttctgacgggcagccctgcttagcaacagctggtcgtggtcatc

SEQ ID NO: 3045 - DNA, 201 bp, Homo sapiens
gagaatgagcataatagggatgtgggataattagtaaaagagaatatatgccaggggttgcgttattgagtggcccacaatttctcaagaaaaaaaaacasctagttacttgatctcacagaagtccccagaagagctacatgaaattatgtggtctcctaacagtttgtcagtgtagggctcagtagagaaagagtgagc

SEQ ID NO: 3046 - DNA, 201 bp, Homo sapiens
tggtcagagaagacacttcatgttatttcaattttttgaatgttttaagacttgttttgtgacctaacacatgatacatgatgtatctttgagaatgatcygtgtgctgagaggagaatgtatattctgtagcttttggatgaaatgttctgtaaatatgtattagaatcacttgttctgtagtgcacattaagtctgatg

SEQ ID NO: 3047 - DNA, 201 bp, Homo sapiens
ctatagaattggtaccaattcttctgtgagtgtctggtagaattctgctgtgactccatctggtcctggacttttctgtgttggtaacttttttatcacartttcaatctcactgcttgttattggtctcttcatggtatctaattcttcctgatttaaactagaagtgtggtatctttccaggaatttatccacctcttc

SEQ ID NO: 3048 - DNA, 201 bp, Homo sapiens
tgccatggagagtaaaataggaatacctacagatataaaatatgttcttgcattaagaatgtgaaagaagtcattactgcttcctattaaataaccatatkctttgtggcttacagaaaagaacagtaggctccttatgctctctctgaaaatttgagccccttcaaagagttattaggttggtagagaaaaaccatccat

SEQ ID NO: 3049 - DNA, 201 bp, Homo sapiens
taagaatgtgaaagaagtcattactgcttcctattaaataaccatattctttgtggcttacagaaaagaacagtaggctccttatgctctctctgaaaatytgagccccttcaaagagttattaggttggtagagaaaaaccatccattaaactcctaagaagagggagtattgctcaaattgatgtttttctgtcatgac

SEQ ID NO: 3050 - DNA, 201 bp, Homo sapiens
atgtctggttataaaaaggaacactaagaaatctgttaaatgttatgttccaagaatagtatctcctatggcaagcaaatggacagaaatatattgggctytaaattgtaatttcacttctttttggccagtgaaatgtgagaaacagggaaagcaatatctgagatggttttcttattcatatattaaccaacatatttc

SEQ ID NO: 3051 - DNA, 201 bp, Homo sapiens
tgtggggtaaatgagatgttttgatacaggcatgcaatgtgaaaaaagcacatgaagaatggggtatccatcccctcaagcattaatccattgagctgcaracactccaactacactctaagatattttaaaatgtgcagttaagttattattgactatagtcaccttgttgtgctagcaaatactaggtcttattcattc

SEQ ID NO: 3052 - DNA, 201 bp, Homo sapiens
cttcttcctttccaatttggatgccctttatatctttctgttgttggaatgctcgaggtaggacttccagtattaggttgaatatcactggtgaaagtgarcatccttgttgtgttccagatcttagaggaaaggctttccatttttccccactcattatgatactagctgtgggtatgtcatatacagtttttattatgt

SEQ ID NO: 3053 - DNA, 201 bp, Homo sapiens
ccaatatttttgggtgccttctatgcaccatccactatggcagataaagtgtacactgtagggagcaataaggatgagtggggttaataaataaaacaagrcatagtcatagacctcaagagaaataaaatctagtatgaaggattcaacatatacctgataaatgactaattacaagtacatgactggtaatttcagagg

SEQ ID NO: 3054 - DNA, 201 bp, Homo sapiens
accttagcccaaggcaccatcatctcttgcctcttctagagcaactgtgttgtcttcttcattctcatctctgcagaccatacacagagaaaccaggaagwtttcttagatttttaaattgagatgaaattcacataacatcaaataaacgatttgaagtatacagtcaaatggtatttaggacatttatatcttgcacac

SEQ ID NO: 3055 - DNA, 201 bp, Homo sapiens
cctctacaaaattaagtctattaagaaaaaactgttaacccggaattgcatgtttaggaaaaatttcctcaggaatgaggaaaaaataataaaagcaatayagcttgaaaagaaagaaataaaatggactctatttgcaaatgacatgattgttcacatagaaaatctcgagaaagctaaaataacactcttgtaactaat

SEQ ID NO: 3056 - DNA, 201 bp, Homo sapiens
ggtcctgttgaatgagtttggaagtattttcttctctattttttggcacagtttaggtagaattggtattagttcttattcaaatgtctagtaaaattcarcagtgaagccatggtgtcccagtctgttccttggtaggagactttattatggctatgatctcattatttgttaatggtctgttcaggttttggatttctt

SEQ ID NO: 3057 - DNA, 201 bp, Homo sapiens
aagatcctgagatacaacatcaaatgcacaatccataaaagaaaaaaactaataaattggatgtcatcaaaattaaaaactttcattctgtgaaagacacwtctaaaagagtgaaaagaaaagctacagagaaaagatttgcaaatctgacaaagaatatgctaacagaatataaaaagaactctcaaaactcagtaattt

SEQ ID NO: 3058 - DNA, 201 bp, Homo sapiens
accttatacaaaaattaactcaaaatacattatagactgaaatataaaacataaaaatataaaactttagggaaaaataggttttcatgacactggcttcraaaaagatcctgagatacaacatcaaatgcacaatccataaaagaaaaaaactaataaattggatgtcatcaaaattaaaaactttcattctgtgaaaga

SEQ ID NO: 3059 - DNA, 201 bp, Homo sapiens
atgagttgtttattgctggaatttttcatttaataattctggaccacagttgactgtgggtaactgaaactgcagaaagcaaaaccgtgggtaaggggaamctactgtatatgcatttctctagagcatcctcccccaatgttgagaaagaatttgaaatgatttacttcccttatcttttttccccacctcaatcgtagg

SEQ ID NO: 3060 - DNA, 201 bp, Homo sapiens
ttgtctgcaactgaatcctgacagtataacctgtgcaggcagcaatgaaggggctttgcattgtcagtgcagtatctgtgcagccactcagggttaaaccractggctcaagtgattctctagtgagagaattgttgttaatgtattaaacagagatggtgatcactcagtctttgtcatctctgtgcaaatccaaattta

SEQ ID NO: 3061 - DNA, 201 bp, Homo sapiens
gatatgcccagtgagggcccggaagctccacacccatttccccatatttcatcctatgcgcctctttttctgtgtcccttcaataacctttctaataagcyggtaaacataaagtaagtaaattacattagatattcaacactgtattataaaataggctttgcattagattattttgcccacctgtaggttaatgtaagt

SEQ ID NO: 3062 - DNA, 201 bp, Homo sapiens
tcttgcttttctagttcttgaagatgcatttttaaattgtttatttgaagtttgttctctttgctaatgtaggcacttatagctatcagcttctctcttastactgtttttgcagtattccagaggtttgggtatgatgtgtcattatcatttttttcaagaaatttttatatttccttcttaatttctcgatttacccac

SEQ ID NO: 3063 - DNA, 201 bp, Homo sapiens
tttcacaagggtgttccctcaaacataactgtctttatggccaacaaataaccaaaaaattttctagtcatttataaaaaatgtgaatccaagaagagtaygagggaaaggaatctaaataatatggaaatgataaatgtcttctattggctgtggctggtagcaggagatctgattattatcagcaagtggccttgacaa

SEQ ID NO: 3064 - DNA, 201 bp, Homo sapiens
ccacaacacaggaaatgtttggagtcccattgataaatgtaccatagggtgatgtcaattcagtcatactcccatctcagatcttacatgctagtcaacastgaggttctccatatagaggtaagaagcaaaagtaaaaaataattaggtaacataaatcatagcttctttaattgttacttctgcacctgcttcataaga

SEQ ID NO: 3065 - DNA, 201 bp, Homo sapiens
cttcagtatcagttgtaatgtctcttctttcatctctgattttatttatttaggccttctctggtttttttttcttagttaatctggctaaaaattcaccrattttgtttaagttttcaacaaacaatcttttggtgtcattgatcttttgtattattttcttatttaaattttatttatttccactataatctttactat

SEQ ID NO: 3066 - DNA, 201 bp, Homo sapiens
tgaaaaatcatattaaaaatgggcaaaatatctgaacacttgcatcaccaaagaaagaaaagaatatgtgcagatgttcaatgtcatgtcataaagaaackgaattaaaacaataacataccattaaatccctattagaatagccaaaatccaaaacactgacaacactaaatactggcaaggatgtgggacaacagtaac

SEQ ID NO: 3067 - DNA, 201 bp, Homo sapiens
tattttgagaataacataataaaaggaaaagtgtgttccatttattgaatacaagcgcctattcttaagagtaaatctgaagccaggaagtagttaagaaytttttctaagttgttagaagtttcctaaactaactttaaagatttattagggttttccagagaaacagaatcaacaggatatatatacatatatgtatct

SEQ ID NO: 3068 - DNA, 201 bp, Homo sapiens
tgatttggggtttttattatggtaggaggtggtgcagaagtaactgttcttttgcacaagctggagcttgcgtagtttgaatttcccatctgctccaaagraaggaacacccaggctttattagcacttgaccaaacaaatatggaacagaaggggcagggagaggaataaaactcaatgctatcacaagtcaaacatcca

SEQ ID NO: 3069 - DNA, 201 bp, Homo sapiens
gcattgtcagtgcagtatctgtgcagccactcagggttaaaccaactggctcaagtgattctctagtgagagaattgttgttaatgtattaaacagagatkgtgatcactcagtctttgtcatctctgtgcaaatccaaatttaccaaaatttgtgcttctgtttttcaaaaacagtccttctctctttttatctcttttc

SEQ ID NO: 3070 - DNA, 201 bp, Homo sapiens
tcgtcatacggtacttgtgctacatatgaagcagtatgatattatttgaaggaggattcatcttagtcacaaatgtattctgaaaactatatggcaaaatmtaaaaaataagtttaaatatcattcctatgctaagagacaaaattaaattatattaaatgctcagttaggcctgaaacacaaaaaggacaataaattaaa

SEQ ID NO: 3071 - DNA, 201 bp, Homo sapiens
ctgagagttgctcctaatatttatctctccctcctcatcaacccactacacaccccaatctctcaccaacgctagccagttccaccttttggctacctccycagcatgttcctcatggccctgtctaggctgccaccaccctagttcatgctattaacatcccctacccagattactccaataatctcccatcttgtctat

SEQ ID NO: 3072 - DNA, 201 bp, Homo sapiens
cactagcttctttcgtttactcactctttaaatacctatgacaagcctatgaaaagtcattgcctgttataattagaaagaagacccaagagagacaccasttagtgacacagttgagctaacaatttttttttttttttttttttttttgagacagagtctcgctctgtcgccaggctggattgcagtggtgcaatctcg

SEQ ID NO: 3073 - DNA, 201 bp, Homo sapiens
agggcaaagaaaaaagatgaaaagttgtcattctactttaaccacaaactatttttgtgattagaacacaaattaatagtttatccttcagccccaagcawctagaaaagtagataagttcttcaatgaataaaattaatcagtgacttttttcactgttggacagacttgctttcagacagaaacagtgaggagaaatgt

SEQ ID NO: 3074 - DNA, 201 bp, Homo sapiens
ctaatttgcattccaatcatcagtgtatgtgctcctttttcacaacatccatgccaatatctattattttttgactttttaataatggccatcctgactgsggtaaggtggtatctccttgtggttttcatttgcatttccctgatgtagtgattttgagcatttttttatgtttgttggccatttgcatatcttcttttg

SEQ ID NO: 3075 - DNA, 201 bp, Homo sapiens
aggcctattcacattggggagggccatctgctttacttagcccaccaattcacatgctaatctcttctggaaacacccagacaggcaaaccaagaattaayatttaaccaagtatttgggtgcaccatcacccagtcaagttgataaataaaattaaccattacaaaaagtggtgaaaataactcctttacacaaaacatt

SEQ ID NO: 3076 - DNA, 201 bp, Homo sapiens
atattggttctcttacttggtatttcagcttagcaaattgtgttcatccagaaactcaggagccaataactccctttcctctaacctataaagttcatcamcctgagctaatttactttctaaatatatctttggttcatccatttctttcatttccattgagagtaacttttctcctctaagctgtcatttgtctctccc

SEQ ID NO: 3077 - DNA, 201 bp, Homo sapiens
caaaggccttagcaagatgtctttggttaaggattactgataataaataaatctaatatcagttatgtgaggcatggctgcctggagaatgtcaggcaacytgtataattatcagcattatagaattagccacataaatacactctgctatgtgaggtaattatctcctcacttggaggtcccattttttacccagaacca

SEQ ID NO: 3078 - DNA, 201 bp, Homo sapiens
ttctgtcatgactgtctttttctcttccctctaattgttctacaaaactgaatttaaggataaactctttaatcataaggatacttaggtcccataccccyattatctccagaaaaatatatataaggaagaggcctgaagatatagttgctaaatatcaacctaccaaaaggtaggagagtactaattatataccatgtt

SEQ ID NO: 3079 - DNA, 201 bp, Homo sapiens
gagttattaggttggtagagaaaaaccatccattaaactcctaagaagagggagtattgctcaaattgatgtttttctgtcatgactgtctttttctcttycctctaattgttctacaaaactgaatttaaggataaactctttaatcataaggatacttaggtcccatacccccattatctccagaaaaatatatataag

SEQ ID NO: 3080 - DNA, 201 bp, Homo sapiens
gaaaaaatatataggcaacactttgaggactagttacaactttattgtaattacagctttgttccacacaacctccttgaaatgttgtgcattcattaagkgttccaaagctgtatcagagaaaaggtggccttgacataccgtccatggaacaggatggctttataggacttaacactgggtgaaatgcagagctacaga

SEQ ID NO: 3081 - DNA, 201 bp, Homo sapiens
agcaggggccagatcatacagaaccctgtcagccattgtaagcactttggattttattcagagtgggatgggaaatatttaaagtcatcattttgaccagyagatgacacaatgggacatatttaaatgggagtactctggtgggagagtaggataaggactgaaggtgagcaaagatggaagcaaggactaattaggata

SEQ ID NO: 3082 - DNA, 201 bp, Homo sapiens
ttataaattatgacacttttcaatgaataaatgacctatagatcagacataccgatcagaccactggtttctgactcatgattataaactatgtggcaacsctaagtatcttttccaatgcacagagtgaatgcacatttttcaacaatacctacctccacaggcacacagacaatgtcattataaagaatatatttgaca

SEQ ID NO: 3083 - DNA, 201 bp, Homo sapiens
atacatttagacttgttgaaagtcagaaatctgatttttaagcaaaatatccaaattttaagttggcaataaatttataatttataaattatgacactttycaatgaataaatgacctatagatcagacataccgatcagaccactggtttctgactcatgattataaactatgtggcaacgctaagtatcttttccaatg

SEQ ID NO: 3084 - DNA, 201 bp, Homo sapiens
tatttctttatcagtctacttaatcacccatccttactgagtggaccaattagttggtcaaaccattaatcagttcactgaattaaattactttatcacayggatggaccaggcaagtcatttaagtaagtgaactaagggtagggaagtggagaaactatggcaaattacagaaggaaggtttcgtagaaagggggcaga

SEQ ID NO: 3085 - DNA, 201 bp, Homo sapiens
ctgagggcagaataatcaatacaaagtccaattgaaaaagttgtcaagaacatgagcaagacaatatttctttatcagtctacttaatcacccatccttaytgagtggaccaattagttggtcaaaccattaatcagttcactgaattaaattactttatcacatggatggaccaggcaagtcatttaagtaagtgaacta

SEQ ID NO: 3086 - DNA, 201 bp, Homo sapiens
aaatacaatgtccacatgttgattattacatttatgtgtttacagtccatatttgtgggggaaataaatacattcatcttcagcaactttctttgtctatrcagtacgtggccagactcatctatctgttgtgatcttgtaaatttccttattccccactatcttatcctatcttttaaaaattcttatctttggttccta

SEQ ID NO: 3087 - DNA, 201 bp, Homo sapiens
aggggtggggtggtgtcagcaattcaaggccatcttttctacccttttcagtgcctcttccctcttcagtgcctctttctttaatatgacgttaaaaccargtactgtaatcagtcacctgatttttggttattataaaggtgcttttttgtgtgaccacttgttcaatttggtgatcccctctgcaagataattgctgga

SEQ ID NO: 3088 - DNA, 201 bp, Homo sapiens
tcctttcctcaagcagaaggagcctctccccataaccaccacaggctggaatatggtgggtcacacccgaagcctgtgttgctctgagtcttacccaaggytcatggtgagtactgccttgctactactgctgattattcagggcccaacggctctttagtcagcatgtgataaatcctgccaggactgggtccttccctt

SEQ ID NO: 3089 - DNA, 201 bp, Homo sapiens
gctgcaggacaaagtcccatttactctcccctttcctttcctcaagcagaaggagcctctccccataaccaccacaggctggaatatggtgggtcacaccygaagcctgtgttgctctgagtcttacccaaggctcatggtgagtactgccttgctactactgctgattattcagggcccaacggctctttagtcagcatg

SEQ ID NO: 3090 - DNA, 201 bp, Homo sapiens
agaaattagccatcttgccatgaaaagacatgtaggaaagttaaatgtatattaataaataaaagaagccaataagaaaaagctacatactgcgtgatttyaactatatgacattctggaaaaggcaaaactatggagacagtaaaaagatcagtggttgtcggggattagagggaagggaggaatgaatagacagagcac

SEQ ID NO: 3091 - DNA, 201 bp, Homo sapiens
ccagaactaggaaaataaaatggtgctaccaacaaaaataaatctgattcttaccacataatcaacaagccttccaaaacctcttcatgttccagagggtycatagggtgtatcgtattccaaaacttctgatcacaatctttcaatctttagtttcatcaattgttccttcccttcttgtcccttttctcagcaaaaggc

SEQ ID NO: 3092 - DNA, 201 bp, Homo sapiens
tgattggaacaaattaccactgtagtatgggatgttgatagttggggaggctgtggggttgtgaaggagcacgtatatgggaactctgaattttctactcrgttttggtgtgaacctaaaactgctataaaaaaaagtctatttaaaacaaacaaatgaaacctcatgtgtgctattttcctctccgatatggtttgactc

SEQ ID NO: 3093 - DNA, 201 bp, Homo sapiens
ttcaaaaaaatccaagaaaatgcttcatgtagaaaaatatatatattttacaatggaaatatcactgtctattgactgagtacatatttatacccaaatcrtaatttgaaatgaaaataacatttaagctaaactcattaatttttttccttaactttttccttagaaggcaaaagcaatgtggcaacttctctttagaag

SEQ ID NO: 3094 - DNA, 201 bp, Homo sapiens
cctctatgttgataacccagctatttccaatctcttttccacccttcatagtttgtggcatttaaaaaatataatgcaataaatgttcatcataaaaaatstacagaatgtataatggtttttaaaatgaagtaaatgtttgttatcttaaaaaggtaaattttatcttacctgcctgtgtcatccttcttattggcatgt

SEQ ID NO: 3095 - DNA, 201 bp, Homo sapiens
atattttatgtgccattgggcagactatagaaaagggtctaaagcaacagtggacaatatttatccctagactgatcactgctttggagctgcctaacaaytaataaatgcaagatcaaaaaagataaaaatgtttccaaataactgcattcataaataaagctcaagaagatttagaagaagacaaaaatatccagcacc

SEQ ID NO: 3096 - DNA, 201 bp, Homo sapiens
ggcaaggaaccaatctggaggactcatgtttcccaatttgagaatttactactacaaagctagaatacttaagactttgtggtattagcataatactagtsatatagatcaacagaatacaatagacagcccagaaataaatccttccaatgaggaccaattggttcttcactacggttccaagatattataatggaaaaa

SEQ ID NO: 3097 - DNA, 201 bp, Homo sapiens
tctcaaaattattgagcattctctttataaaatacaaatataaacatgacacttcactgattcaaaacaaacagaaaacattctccattgttcttaaagaytgaaatccttaatgttgcctaaaagtaaaatatccataaaatgtattgtcaaaaccagtacacttttaagaggagtgtgtgcgtgcatgagtgtgtgtgt

SEQ ID NO: 3098 - DNA, 201 bp, Homo sapiens
aaattggtgaagttacgattaaccattacacgttaaaaaaaaaaaaaaaaagaagctcagtctcacttcatttattcctttgacaaatacagattgagcaytttgtctaaaggatacgctacactagacacaaggacaaaggaatgagcaaaagatataaagttccgtgtcctcaaaaagtttgtattctagtgagaagac

SEQ ID NO: 3099 - DNA, 201 bp, Homo sapiens
ttagtctttccttcatagcatcatctatcatagtacaggttatacagagtgacaagggaaagggtggggataaagaaaagggtagaattccacataggatsgtcagagatggcttagtggcatggtggcctatcagcaacaacacaaggaagtgagggagcaatccatgaggataccagaagaaagagttagagcaatcca

SEQ ID NO: 3100 - DNA, 201 bp, Homo sapiens
aggactaattaggatagtatggcaaaaatccgggaaagagataatggtggcttgaatcagagtgctggcagtagtggtggtgaaagtggtaaaattctgayatattttcaagatagatctggctggatttgccaatggattaaatatgcagtatgagaaaagaaaaatgtcaaaatggctccaaatattgacttatgcaat

SEQ ID NO: 3101 - DNA, 201 bp, Homo sapiens
taaaaaaaaaaaaaaaaagaagctcagtctcacttcatttattcctttgacaaatacagattgagcattttgtctaaaggatacgctacactagacacaakgacaaaggaatgagcaaaagatataaagttccgtgtcctcaaaaagtttgtattctagtgagaagacagataataataaaataataaatatttagtcttt

SEQ ID NO: 3102 - DNA, 201 bp, Homo sapiens
ctgaattttctactcggttttggtgtgaacctaaaactgctataaaaaaaagtctatttaaaacaaacaaatgaaacctcatgtgtgctattttcctctcygatatggtttgactctctgtccccacccaaatctcatgttgaattgtgatccccaatgttggaggtggggcctggtggaatgtgattggatcacggaggt

SEQ ID NO: 3103 - DNA, 201 bp, Homo sapiens
cctgtagcaggatccttctgacccagactatctgcctgaattgccactttcccctttttgatattatgctctccctataatcagagttatctctgattgtstacttttggacttctcctgagatgaacaatgggcttattctcacaactatttctgtggcctatcccaacccctgccctgtccattcaggccatccaatct

SEQ ID NO: 3104 - DNA, 201 bp, Homo sapiens
tatagactcagtacaatgtgtgaagcaatgatgtattgacatatagatatttttccctttaaaagcctccaaatgtcaaatttcatttatcaactcttaargtgccatggagagtaaaataggaatacctacagatataaaatatgttcttgcattaagaatgtgaaagaagtcattactgcttcctattaaataaccata

SEQ ID NO: 3105 - DNA, 201 bp, Homo sapiens
tttccctttaaaagcctccaaatgtcaaatttcatttatcaactcttaaggtgccatggagagtaaaataggaatacctacagatataaaatatgttcttkcattaagaatgtgaaagaagtcattactgcttcctattaaataaccatattctttgtggcttacagaaaagaacagtaggctccttatgctctctctgaa

SEQ ID NO: 3106 - DNA, 201 bp, Homo sapiens
cctatgagctctatgtctttcctccatttctttaatgctgtgaaatcaagtactgctcccgaacttcagctcacctgtagcaggatccttctgacccagaytatctgcctgaattgccactttcccctttttgatattatgctctccctataatcagagttatctctgattgtctacttttggacttctcctgagatgaac

SEQ ID NO: 3107 - DNA, 201 bp, Homo sapiens
aaatataatgcaataaatgttcatcataaaaaatgtacagaatgtataatggtttttaaaatgaagtaaatgtttgttatcttaaaaaggtaaattttatsttacctgcctgtgtcatccttcttattggcatgtctatatcctacctgaaaaaaatacacggaagttatcaagcactatactttactctttttgaacatc

SEQ ID NO: 3108 - DNA, 201 bp, Homo sapiens
aattgttccttcccttcttgtcccttttctcagcaaaaggctatatcaggtgatccttatcatggaaccaccacagcagcccaggatttcacaccattcaycctgactcaataaactgaggtggggcatgggactctgcatttttaataaacaacctgggtggttctgaagcaagtggtccatctatatattttgacaaat

SEQ ID NO: 3109 - DNA, 201 bp, Homo sapiens
atcatggaaccaccacagcagcccaggatttcacaccattcaccctgactcaataaactgaggtggggcatgggactctgcatttttaataaacaacctgkgtggttctgaagcaagtggtccatctatatattttgacaaatgcagatatgtattccttccatttctagccctatagtactccccacctgtcttctttcc

SEQ ID NO: 3110 - DNA, 201 bp, Homo sapiens
gcctatatctagcaaaggaattgaatcaaaaattaataactttcaaaaagagaaggaatcctgattgaaaaagcagtaatacatccttatttgcagaaacrtggtcttgtatacagaaaatcttaaggaaccaactaaaaagcaaagttgcaggatataacatcactacacacaaatcaactgtatacatgccaccaatga

SEQ ID NO: 3111 - DNA, 201 bp, Homo sapiens
tttctctctctctctctctctttctgcttgtagaatcgtttctttgtccttaacctttgggagtttgattattaaatgttttaaggtagtcttaatttggytaaatttggttggtattctataatgttcttataggctattgatacctttctgaaggtttgggaagttctctgttattttccctttggataaactttctac

SEQ ID NO: 3112 - DNA, 201 bp, Homo sapiens
gtgatagtgatgtgtcaatgtagattcattgattggaacaaattaccactgtagtatgggatgttgatagttggggaggctgtggggttgtgaaggagcasgtatatgggaactctgaattttctactcggttttggtgtgaacctaaaactgctataaaaaaaagtctatttaaaacaaacaaatgaaacctcatgtgtg

SEQ ID NO: 3113 - DNA, 201 bp, Homo sapiens
gatctaaattgttaatcacttcagctttatctgcattgggggcaccccaagttcaataatggtgtggctcttgcagacttgtagcgatactattttcttgstcttgggtaagatctgggagaattccctgaattaccaggcagagacttttgttctcttcccttattttcccacaaacaaagagtctctttctctatgatg

SEQ ID NO: 3114 - DNA, 201 bp, Homo sapiens
agagagatttcggctgaaaatgtgaattgggtgctatcatcacataaattatatgaaaagccaaaagaattagatgagcttaactggtgttgaccgaaaakaaaagaggtccaaagaatgagcccgtgagtaatccaacattaagaaaacaaataaatgaaagaggaaggtggggaagagaaccggcaaaagagacgggga

SEQ ID NO: 3115 - DNA, 201 bp, Homo sapiens
tgaaaagccaaaagaattagatgagcttaactggtgttgaccgaaaagaaaagaggtccaaagaatgagcccgtgagtaatccaacattaagaaaacaaakaaatgaaagaggaaggtggggaagagaaccggcaaaagagacggggaatgagcaaacagtgaggcagaagggaaactaggaaagagttggtgacctggtg

SEQ ID NO: 3116 - DNA, 201 bp, Homo sapiens
gttccacacaacctccttgaaatgttgtgcattcattaagtgttccaaagctgtatcagagaaaaggtggccttgacataccgtccatggaacaggatggytttataggacttaacactgggtgaaatgcagagctacagaataactacagtcattagtgccatgaatatttcataacctttaaggaattgaattaaattt

SEQ ID NO: 3117 - DNA, 201 bp, Homo sapiens
atacttcctgcaactgcattagatgcaagaagagagggcagtctataactattgcttactttaatgaaattacctataacctgattctttgctaaaagtarcagccaattactctgtaatccacatgtatcttaggtaacagtaggaggaaattactacgtgatgttctctttggtaacttgaaaccaacgaaagcatatt

SEQ ID NO: 3118 - DNA, 201 bp, Homo sapiens
ggatgtgtttccatttgtttgtgtcatctatgattttgttcagcagtgttttgtagttttccttgtagaggttttttgtttttgtttttttttacctcctktgttaagtacatttctaagtattttcttttgtgtatttatttttattttttgcagctgttgtaaaggggttgagttctcgatttcattcaaaccttggtc

SEQ ID NO: 3119 - DNA, 201 bp, Homo sapiens
tatctctccccaaaattaaattcatcctagaaaaaataaatctttgtttaaccaccactgtgctcaagaaattgtctcatcttactctccaacctgcagcragggggagaagaaaggaagaggtaagataaaccgtgactccacagggcagtgctgggttaatcctaagggtagtgatgggtggtggtagagagggcttgg

SEQ ID NO: 3120 - DNA, 201 bp, Homo sapiens
gaaccctatttcttctcacagggaatggtatttagggaatacaacctctgcaaggagtgcttattgctaatgggttggtaattatttctagaccttttcaktggacagacttaggaaatacatatctttttttaaaagacagagtttattatgagtttatattgatattttcaattcaaatttaggtttgcagagttactt

SEQ ID NO: 3121 - DNA, 201 bp, Homo sapiens
taagtgttccaaagctgtatcagagaaaaggtggccttgacataccgtccatggaacaggatggctttataggacttaacactgggtgaaatgcagagctrcagaataactacagtcattagtgccatgaatatttcataacctttaaggaattgaattaaatttaatacttcctgcaactgcattagatgcaagaagaga

SEQ ID NO: 3122 - DNA, 201 bp, Homo sapiens
tgacataccgtccatggaacaggatggctttataggacttaacactgggtgaaatgcagagctacagaataactacagtcattagtgccatgaatatttcrtaacctttaaggaattgaattaaatttaatacttcctgcaactgcattagatgcaagaagagagggcagtctataactattgcttactttaatgaaatta

SEQ ID NO: 3123 - DNA, 201 bp, Homo sapiens
gaacatctctgttgttatctaggtagaagttgatacatccactcttattgctaacatcttttcactagaatttggatttaatttatttaaaggcctgaggrcagaataatcaatacaaagtccaattgaaaaagttgtcaagaacatgagcaagacaatatttctttatcagtctacttaatcacccatccttactgagtg

SEQ ID NO: 3124 - DNA, 201 bp, Homo sapiens
cagagggtccatagggtgtatcgtattccaaaacttctgatcacaatctttcaatctttagtttcatcaattgttccttcccttcttgtcccttttctcakcaaaaggctatatcaggtgatccttatcatggaaccaccacagcagcccaggatttcacaccattcaccctgactcaataaactgaggtggggcatggga

SEQ ID NO: 3125 - DNA, 201 bp, Homo sapiens
gttctgagtgtgagtcaccacctttcctgctgttggtcttctcaatcctagggtaacaactaaaaagcgatgactagagatgcctgtgatgcttaaaagcrgacacctggacattattcatttggcaattgtatcaacaattaattttaaagtttgttcttttctctgtaaacaagtgtataacgtttataaataacagtg

SEQ ID NO: 3126 - DNA, 201 bp, Homo sapiens
gggcaatatgtacattttaacacttcaagaaggaaaagtgataaacttcccagatagatttcctgctccacaaactgacaataatgtcccagagttcataygatgtagccataaaacactggagtgttgtttctgtaagaagaacacctctgtcatggcgtccatctgtagaaaccctgccctgtatcataagcctggatc

SEQ ID NO: 3127 - DNA, 201 bp, Homo sapiens
ggatttaaccttgcaactgccttccacaccccttggcccagataactgagagctacgtgagcctagaaaatgaatcagaactaaggttcaggggacaaaamtccccaccgacctttcccggagttgttccttcatgcactgtagcacacccatggaaacttcctcctaggttatcctaagtcaaagtggctgctaccactt

SEQ ID NO: 3128 - DNA, 201 bp, Homo sapiens
agaggatggctcaggatttaaccttgcaactgccttccacaccccttggcccagataactgagagctacgtgagcctagaaaatgaatcagaactaaggtkcaggggacaaaaatccccaccgacctttcccggagttgttccttcatgcactgtagcacacccatggaaacttcctcctaggttatcctaagtcaaagtg

SEQ ID NO: 3129 - DNA, 201 bp, Homo sapiens
taatctttaggcttagtgcacagagaatagcaccaagagggtaaatgttggagagacagtattctaacatatccaatttgccctataatttgttgagcacrtgaagtatctaccgtgttttgagaacttcctaactagttttcctggtgcaataagagtgattgatagtttcaaaattaattttgcaatcttgaatcttca

SEQ ID NO: 3130 - DNA, 201 bp, Homo sapiens
cacatatccatgaagccgaccctgttcctattttccctacttgccaacacataccacaaagagagagaaagaaaaaagtaggggaggagaaagagaaagargtgagttagtgggaagaacaaattggcttggtttttatgagctatcaataatctcttgctgtcactataaagcatacataattttttacatatagcaata

SEQ ID NO: 3131 - DNA, 201 bp, Homo sapiens
ctgatatggcttctctggaaatgaccagagctcccttctttggctccaatattggtacttgccttttggattttgtccactaatgaaagatctggatactytgcctgactcactccattcctggaacttacctcagtgctgacctctaaggccagctagtttctggtcctgtacaaaggaaactgaacaagcatagcaagt

SEQ ID NO: 3132 - DNA, 201 bp, Homo sapiens
ctaggagtcaggggtttccagattggcctctctcttttatttttttgagacagggtctcactctgttgtccaggctggagtccagtagcataatcatgacraactgcaggctctaccttctgggctcaggtgatcctcccacctcagccccccaagtagctgggggactataggtgcgtgccaccaggcctgctaattttt

SEQ ID NO: 3133 - DNA, 201 bp, Homo sapiens
ctgcactccagcccgggtgacaacagtgagagactccatctcaaaacaaagagaaagtcaacagatggatcaccatccttccagatcagaaaaacaggctrgggcaaagggcaattgcttacgcttaccttaccgatttttccagggtttaagcgtgctgtgaaaatttaaatttctttctttctttctttctttcttctt

SEQ ID NO: 3134 - DNA, 201 bp, Homo sapiens
atcttgactgtcttttgaacctgcatgggtccttgagactgccacaaccaacagatgcagtgacactgtggaacttccaagggaagatgataaagatcaayatagcttctgtctagaacacacgctctatctcttgagatgctcaccagtgaaatctaattaccatgagaagccacttgcagagaaagtgaagcccctagc

SEQ ID NO: 3135 - DNA, 201 bp, Homo sapiens
aaaaaaaaaaaaaaaaaaaaaagttatagtaattaagacaacccaaggatagagagaaaaagaaaacagaatataaagtcagaggtaatatttaaaggtcrgagggaagaattttatccctgtattctccaagaaagtctgcaataacatttcccatcctacatgctcttccaaaatcttgactgtcttttgaacctgcat

SEQ ID NO: 3136 - DNA, 201 bp, Homo sapiens
taatataatttagatgacaacccctgccctttttttcttttgaggtggagtaaaagaaagttataaaattattttaaaatcaaaacttctcccaagtttcrgcaaaagatgatttgggggtggagtagggaaggaggatattaagataccataaagctatagaggtcaaaacagtaatttcataaatataataggtggaaa

SEQ ID NO: 3137 - DNA, 201 bp, Homo sapiens
ctaggaattgtcccctggggcattatttggtttcctctcacttaccagagtcacttaggataaatctgaattctgagttgtttgccaaatgctggatcctygctggatactccttggattccttgaagaattcagcataatataaaacagcttaaagtcaagaagccccttctgagacccttaccaagggaggcaggagga

SEQ ID NO: 3138 - DNA, 201 bp, Homo sapiens
ggaggcaggaggagggacaaaatacaacaatcactatcattccacacaaccatatacaaatcatcatagcaatggatgctgcctgttacgtgcctgactcygtgctagggctgttacctcatcatatcctcaaacaacaaaggaagaattacatctcacaaagtgtaaattctttgccaaagggtcctgtgaccaatgtca

SEQ ID NO: 3139 - DNA, 201 bp, Homo sapiens
gtggttatcattgtgacgtttccttcatgtaatgcaaaatagcccctactttccacatctactgaactgcaccttcatctgtattgtcagtcatcattttyctggctgtataagtgctttctccaaaagacttctctcccatctcatcaatcaccaaaccctgatgcttttattctttagaatatctctggaaaccagtgc

SEQ ID NO: 3140 - DNA, 201 bp, Homo sapiens
tcccatctcatcaatcaccaaaccctgatgcttttattctttagaatatctctggaaaccagtgcccattctccatcctcactccaccacggccacatctstcttctagattcttgccatagtttgctaatagaactccctgcgtcaacatcctccagcccatccatactccaaactccaaatggcaaccagagagctcct

SEQ ID NO: 3141 - DNA, 201 bp, Homo sapiens
attcacccagtccataggatctggaggagggtcaggagctggggcagcatggatctcctcgttcctgctgcgctgtctctgtgtgccatttgcttctctcyacgtccctcttctctggttcctcggaactacagcttgcatgtcatggctgccctggccactctcccactctctctcgaagccttacctctcaccactaat

SEQ ID NO: 3142 - DNA, 201 bp, Homo sapiens
gactggagagtagtggcacctgtattacagatttctgactctgaactatggatattaatactgtcaggaccaaaactcatctctctctctctttctcatgmcttgaaaaagcaacacgttgagtccgtaactcatggcaccaaacttgacttcccccaaaacttactctggcagtgaaatatctgagaacagaaaaaagga

SEQ ID NO: 3143 - DNA, 201 bp, Homo sapiens
atggagtggtaagaagcagtgagccaccaggacacgcagtgaacactgatgtcctactgcatttctgcagagcggcggaaggtgtgggctgctgtgcgtcrgatcacgtgggaatgcatgggatcaggtagaatggatgggtcacaggagtgccaggcattgtaaatggggaagagttgaacatctcagtaactgaggaac

SEQ ID NO: 3144 - DNA, 201 bp, Homo sapiens
gtgaggcctcttgggagacagccaggaagccttgcccagagatgcctctcctctccacccctcatatgaagggctctgtgctttttaggttctggttttarttactccccagcatagcacagtacagctcaatagaactttctgcaatggtggaaatactccatatccatgtagtccctagcagtacggctagtcacaagt

SEQ ID NO: 3145 - DNA, 201 bp, Homo sapiens
atgtcagttgtaaaagcatgcaaagaagctgataatgaatgctttcagaagataacagtgtaaaaacctgaccttgaatcaatgatagcacaattactttrtagaattatttaatcaatgatgattttcctaccttaaaataattatattctttaacagaacctctggaagaaaaaacatagtgtgcctcattcttttttt

SEQ ID NO: 3146 - DNA, 201 bp, Homo sapiens
gcaagggacactaactgcagttactccacctctccactgaaatagttaatggatatacccaaacacaattttggatttccccaccctgcaccccactccamcctccagggtcttagtgtcttgtcactcgcatgtgggacccgtaataactccaacagggatgacacaaggttcaagaggccgaaggagagacctggaggc

SEQ ID NO: 3147 - DNA, 201 bp, Homo sapiens
atgttacaaagacctgcttgtcctcttcagagaaggcgagggagaaaaagtttgttcttctgggctaagcctaagggaaaataagctggtgaatttctcastttattttcagatattcttgccaagaaggaaggcccaactattaaggggtcaggagggaagcagggtttaggaggattgatcaggaagggtttttggagg

SEQ ID NO: 3148 - DNA, 201 bp, Homo sapiens; identical to SEQ ID NO: 1966

SEQ ID NO: 3149 - DNA, 201 bp, Homo sapiens; identical to SEQ ID NO: 1967

SEQ ID NO: 3150 - DNA, 201 bp, Homo sapiens; identical to SEQ ID NO: 1968

SEQ ID NO: 3151 - DNA, 201 bp, Homo sapiens; identical to SEQ ID NO: 1969

SEQ ID NO: 3152 - DNA, 201 bp, Homo sapiens; identical to SEQ ID NO: 1970

SEQ ID NO: 3153 - DNA, 201 bp, Homo sapiens; identical to SEQ ID NO: 1971

SEQ ID NO: 3154 - DNA, 201 bp, Homo sapiens; identical to SEQ ID NO: 1972

SEQ ID NO: 3155 - DNA, 201 bp, Homo sapiens; identical to SEQ ID NO: 1973

SEQ ID NO: 3156 - DNA, 201 bp, Homo sapiens; identical to SEQ ID NO: 1974

SEQ ID NO: 3157 - DNA, 201 bp, Homo sapiens; identical to SEQ ID NO: 1975

SEQ ID NO: 3158 - DNA, 201 bp, Homo sapiens; identical to SEQ ID NO: 1976

SEQ ID NO: 3159 - DNA, 201 bp, Homo sapiens; identical to SEQ ID NO: 1977

SEQ ID NO: 3160 - DNA, 201 bp, Homo sapiens; identical to SEQ ID NO: 1978

SEQ ID NO: 3161 - DNA, 201 bp, Homo sapiens; identical to SEQ ID NO: 1979

SEQ ID NO: 3162 - DNA, 201 bp, Homo sapiens; identical to SEQ ID NO: 1980

SEQ ID NO: 3163 - DNA, 201 bp, Homo sapiens; identical to SEQ ID NO: 1981

SEQ ID NO: 3164 - DNA, 201 bp, Homo sapiens; identical to SEQ ID NO: 1982

SEQ ID NO: 3165 - DNA, 201 bp, Homo sapiens; identical to SEQ ID NO: 1983

SEQ ID NO: 3166 - DNA, 201 bp, Homo sapiens; identical to SEQ ID NO: 1984

SEQ ID NO: 3167 - DNA, 201 bp, Homo sapiens; identical to SEQ ID NO: 1985

SEQ ID NO: 3168 - DNA, 201 bp, Homo sapiens; identical to SEQ ID NO: 1986

SEQ ID NO: 3169 - DNA, 201 bp, Homo sapiens; identical to SEQ ID NO: 1987

SEQ ID NO: 3170 - DNA, 201 bp, Homo sapiens; identical to SEQ ID NO: 1988

SEQ ID NO: 3171 - DNA, 201 bp, Homo sapiens; identical to SEQ ID NO: 1989

SEQ ID NO: 3172 - DNA, 201 bp, Homo sapiens; identical to SEQ ID NO: 1990

SEQ ID NO: 3173 - DNA, 201 bp, Homo sapiens; identical to SEQ ID NO: 1991

SEQ ID NO: 3174 - DNA, 201 bp, Homo sapiens; identical to SEQ ID NO: 1992

SEQ ID NO: 3175 - DNA, 201 bp, Homo sapiens; identical to SEQ ID NO: 1993

SEQ ID NO: 3176 - DNA, 201 bp, Homo sapiens; identical to SEQ ID NO: 1994

SEQ ID NO: 3177 - DNA, 201 bp, Homo sapiens; identical to SEQ ID NO: 1995

SEQ ID NO: 3178 - DNA, 201 bp, Homo sapiens; identical to SEQ ID NO: 1996

SEQ ID NO: 3179 - DNA, 201 bp, Homo sapiens; identical to SEQ ID NO: 1997

SEQ ID NO: 3180 - DNA, 201 bp, Homo sapiens; identical to SEQ ID NO: 1998

SEQ ID NO: 3181 - DNA, 201 bp, Homo sapiens; identical to SEQ ID NO: 1999

SEQ ID NO: 3182 - DNA, 201 bp, Homo sapiens; identical to SEQ ID NO: 2000

SEQ ID NO: 3183 - DNA, 201 bp, Homo sapiens; identical to SEQ ID NO: 2001

SEQ ID NO: 3184 - DNA, 201 bp, Homo sapiens; identical to SEQ ID NO: 2002

SEQ ID NO: 3185 - DNA, 201 bp, Homo sapiens; identical to SEQ ID NO: 2003

SEQ ID NO: 3186 - DNA, 201 bp, Homo sapiens; identical to SEQ ID NO: 2004

SEQ ID NO: 3187 - DNA, 201 bp, Homo sapiens; identical to SEQ ID NO: 2005

SEQ ID NO: 3188 - DNA, 201 bp, Homo sapiens; identical to SEQ ID NO: 2006

SEQ ID NO: 3189 - DNA, 201 bp, Homo sapiens; identical to SEQ ID NO: 2007

SEQ ID NO: 3190 - DNA, 201 bp, Homo sapiens; identical to SEQ ID NO: 2008

SEQ ID NO: 3191 - DNA, 201 bp, Homo sapiens; identical to SEQ ID NO: 2009

SEQ ID NO: 3192 - DNA, 201 bp, Homo sapiens; identical to SEQ ID NO: 2010

SEQ ID NO: 3193 - DNA, 201 bp, Homo sapiens; identical to SEQ ID NO: 2011

SEQ ID NO: 3194 - DNA, 201 bp, Homo sapiens; identical to SEQ ID NO: 2012

SEQ ID NO: 3195 - DNA, 201 bp, Homo sapiens; identical to SEQ ID NO: 2013

SEQ ID NO: 3196 - DNA, 201 bp, Homo sapiens; identical to SEQ ID NO: 2014

SEQ ID NO: 3197 - DNA, 201 bp, Homo sapiens; identical to SEQ ID NO: 2015

SEQ ID NO: 3198 - DNA, 201 bp, Homo sapiens; identical to SEQ ID NO: 2016

SEQ ID NO: 3199 - DNA, 201 bp, Homo sapiens; identical to SEQ ID NO: 2017

SEQ ID NO: 3200 - DNA, 201 bp, Homo sapiens; identical to SEQ ID NO: 2018

SEQ ID NO: 3201 - DNA, 201 bp, Homo sapiens; identical to SEQ ID NO: 2019

SEQ ID NO: 3202 - DNA, 201 bp, Homo sapiens; identical to SEQ ID NO: 2020

SEQ ID NO: 3203 - DNA, 201 bp, Homo sapiens; identical to SEQ ID NO: 2021

SEQ ID NO: 3204 - DNA, 201 bp, Homo sapiens; identical to SEQ ID NO: 2022

SEQ ID NO: 3205 - DNA, 201 bp, Homo sapiens; identical to SEQ ID NO: 2023

SEQ ID NO: 3206 - DNA, 201 bp, Homo sapiens; identical to SEQ ID NO: 2024

SEQ ID NO: 3207 - DNA, 201 bp, Homo sapiens; identical to SEQ ID NO: 2025

SEQ ID NO: 3208 - DNA, 201 bp, Homo sapiens; identical to SEQ ID NO: 2026

SEQ ID NO: 3209 - DNA, 201 bp, Homo sapiens; identical to SEQ ID NO: 2027

SEQ ID NO: 3210 - DNA, 201 bp, Homo sapiens; identical to SEQ ID NO: 2028

SEQ ID NO: 3211 - DNA, 201 bp, Homo sapiens; identical to SEQ ID NO: 2029

SEQ ID NO: 3212 - DNA, 201 bp, Homo sapiens; identical to SEQ ID NO: 2030

SEQ ID NO: 3213 - DNA, 201 bp, Homo sapiens
gacagggttccattttgttggccaggctggtctcaaactcctgacctcaggcgatccatccgcctcagcctcccaaagctctctatttttataatagttaygttgacttgttcttctggctgcagctgcagctttttccagttgtctcttcctgttgtcacaataaaaaaatctcttctttatttcctgtctatatgtgtt

SEQ ID NO: 3214 - DNA, 201 bp, Homo sapiens
aagtgtgtttaagcgctatgtgcttatgcataggatatttaaagatcaggcaatatagttgccagaatttatagtccatagtcctttcacctgtgaaaaamaaaaatgaagtgaggagagcaatatattatcttgacctcacagggaggaagattggcggtacaacttttacacaattacagagacaaacaagtgcagtgc

SEQ ID NO: 3215 - DNA, 201 bp, Homo sapiens
gctgatggaaaataaatgggaacaagaaagatttaggaaatgttcccaagtcttttgaggaagactgaattaataaaaactgtgagattattggagtaagrttgtctattcttgtgttctaatataccattgaaccatgacctttccaatgcactacctgtaaatataaaggtatatttaatagaagaaatttttctgata

SEQ ID NO: 3216 - DNA, 201 bp, Homo sapiens
tatagttgccagaatttatagtccatagtcctttcacctgtgaaaaaaaaaaatgaagtgaggagagcaatatattatcttgacctcacagggaggaagaytggcggtacaacttttacacaattacagagacaaacaagtgcagtgcaagaatgaaaacctatcttgccttagactccacaggttatctgccctggatca

SEQ ID NO: 3217 - DNA, 201 bp, Homo sapiens
acaaaatatcccaaaataggtttggagagaaaatgagaaagaaagagtcttggtgattgaagggaattagaaatgatagaagaaggggagatacatagctytctcttggttgattatcttgcactgaggaatttctatgagaacggatctagggaagtacaacttagtccaggttagatgactttcagaggcaatttctgc

SEQ ID NO: 3218 - DNA, 201 bp, Homo sapiens
tggaaactactacttgctctatttcccttcgagggctttttgggaaatccatacagtaacaaaaaaaaaaaaaaaaaaaaaaaagacaacacattaccaaygctaagtgcaaagtcacaaagtcatgttacaaatgtctacaggagcaaaactacagtcaagaacaatgtcataagatattttaaaattcatggctgtgga

SEQ ID NO: 3219 - DNA, 201 bp, Homo sapiens
cagctggggacattaataatcatttttctcatcagactgctgaaaatgagagcaaagtgagaaagggaaaaaaacaagtgttttgctgcctcctgtttgarttaatctcttctgacaactgctgatttgggtttgtgattcgatcttccatatgtctagctccattggtcaattaagtgtcgagggtgattgggggaagca

SEQ ID NO: 3220 - DNA, 201 bp, Homo sapiens
cctaatgaccagaatctcatgggctgaggcctgagtaagcacaagttatcaagctcccttaaggtgacccttatgcatactaaagtttgaaagccaactgyatagggatgatctagcaggtttgagccactggggagggtctttctgaagatgagaaaactgaatgaatgtagggagagaacacacctgagcaatggcagc

SEQ ID NO: 3221 - DNA, 201 bp, Homo sapiens
aggaaaggatgtgaaggaggctttgaactggggcaaaaggtggcaatgaggtgtggctgtatcccaggaatactcagggaagcagataatgtagttaaaakgtcccgacctaataagagaggtgggcaggtggggataactaaaaaagagtgcataaaagaacgttgtccaagttggcaccagagtgggggagtttttaag

SEQ ID NO: 3222 - DNA, 201 bp, Homo sapiens; identical to SEQ ID NO: 2072

SEQ ID NO: 3223 - DNA, 201 bp, Homo sapiens
tgcatctgagccaggtcctacagcatgggcttctggggatgtcaaagtgttatcagaaagggatcctgatccagaccccaagaaatagttcttggatcttycttgtacaagaaagaattcgggggaagtctacagagtaaagtgaaagcaaggttattagacaagtaaagaaacaaaagaatggctactccatagtcagag

SEQ ID NO: 3224 - DNA, 201 bp, Homo sapiens
tgcagcttgtgccaacctcttgtctcatctgtgactaaggatgcttaccctcctggggctgcagcccagcaggtcccagccttattttacccagcacttaytcaagatgagttgctctggttcgaatgtctttgacaaagggacagagaacaaaattagtgggatccaatcctggaatctcacagctcacagcctaccacc

SEQ ID NO: 3225 - DNA, 201 bp, Homo sapiens
atgctagtgatttttgtacattgattttgtatcctacaattttgctgaagttgtttatcagctgaaggagcttttgggccgagactatggggttttttagwtacagaatcacgtcatctgcaaacaaagataatttggcttcctcttttctatttggatgtgatttatttctttctcttgcctaattgctctggctaggac

SEQ ID NO: 3226 - DNA, 201 bp, Homo sapiens
ttgttggtgtataggaatgctagtgatttttgtacattgattttgtatcctacaattttgctgaagttgtttatcagctgaaggagcttttgggccgagaytatggggttttttagttacagaatcacgtcatctgcaaacaaagataatttggcttcctcttttctatttggatgtgatttatttctttctcttgcctaa

SEQ ID NO: 3227 - DNA, 201 bp, Homo sapiens; identical to SEQ ID NO: 2073

SEQ ID NO: 3228 - DNA, 201 bp, Homo sapiens
tctgaggaaacaaagggaaatgaacaaagcaaatataaatccataaaatgaaatgcagattacagcttctacaagagcctctgataaactccccacagtgsccagaaacaatggggccaactggagctgggagcctgttcccagctgaaaattgaagccctgtctctgcagtggagcctcctctgcctctggattgttttc

SEQ ID NO: 3229 - DNA, 201 bp, Homo sapiens
tttacaccccctagcacagggttcactagacaatattctctcctgcagaagggcatggagatgagtccctggcccagtcagaacacctcatgccaactggygcttttccaacatgtatgcccttcccagaggctctgagaacagagtgcagtctaggggcctgtctaaatgggttgggctcttcagactgaagtgccatat

SEQ ID NO: 3230 - DNA, 201 bp, Homo sapiens
cactagacaatattctctcctgcagaagggcatggagatgagtccctggcccagtcagaacacctcatgccaactggtgcttttccaacatgtatgccctycccagaggctctgagaacagagtgcagtctaggggcctgtctaaatgggttgggctcttcagactgaagtgccatatttcttctttctcccattggcatg

SEQ ID NO: 3231 - DNA, 201 bp, Homo sapiens
ctcacactcagcttacctgcctgccccatgtaggcactggtgcatgcctgtgtaggtattggtgtgtgcaacccctaaattagagggaaggcccctagcamctgcttcctggaaactacaattgccttgaatacacagctggaattactgaggcaaactttaatatagtttctggtcccagatttcccagaggctcccctt

SEQ ID NO: 3232 - DNA, 201 bp, Homo sapiens; identical to SEQ ID NO: 2074

SEQ ID NO: 3233 - DNA, 201 bp, Homo sapiens
atagggattaccttggggccattttaaaatgtggattcctgaacactcccctggagattctaagctgaaaccgacatgacccctaggccagtgaaaagcaygaggaagaggacagagtaccgggagagtccctgaaagacttggaatctggagcttgctgggtgaacaaattgtgtgatttggacaaattccttcacttcc

SEQ ID NO: 3234 - DNA, 201 bp, Homo sapiens
tttgtcgattaaaagtggtgagagtagacatcctcgctgtgttcctggtcaagaggggaaagctttctgtgttttttcatcactgagtgtgatctttgccrtgggttttttgtagatccccttttccaggctgagaaagttcccttctatttctagtttgttgagagttaaaaaaaaagtcaataggtactgaattttaaa

SEQ ID NO: 3235 - DNA, 201 bp, Homo sapiens
gacttttaactgaaatacactgtttttttaccccctgaatcttagttacccatttgtgaaataaatatgacatctactcatgagacccttgtcgagtccarttatatttatataaagggaaggcactcctctttccatggtgagacccgggatgtctgggtgctttcaatctcccaagccactcctcccaaaacctcagtt

SEQ ID NO: 3236 - DNA, 201 bp, Homo sapiens
gaaattaatgccagtaatcattatcttttgaatatcttctgtagtgctttttgataatttgcatacagcgacacatggaatattccatccaactcatagtrtacatattattttcccaaagataaaatcagaaatttagtaatactaatcaaagctctaaaagagggacagagcaggatagccaaatagaagcctgcactg

SEQ ID NO: 3237 - DNA, 201 bp, Homo sapiens
gtattcagaatcaagatggagaaccacaaaggaagttaaatgtaagctagacgctgtttttcaatgggcagagatggggctctctgggctacatgacctcrggaaatggggataatcaaaattgcctgtgaagtttttgtcaaattatcaaaacccctttataggagactatcagagtaaatttggatcagaaaagctctg

SEQ ID NO: 3238 - DNA, 201 bp, Homo sapiens
tggccaacctaagtagagaagcatgagatggagatccaaaagcattggcttggtagtcaggaagacctgagttcaagttcagagtccttggacttgtgacrgtggacaaatgccatagcctgctcaaggtgatattaataataaaaatataactcgtactttgctttgaggattaaattaaactgcccatgtggaaaaccc

SEQ ID NO: 3239 - DNA, 201 bp, Homo sapiens
aaagaaaaaacaaatcaaggattcctcctagtttggggccttgataactgggttgatggtggattttggtggggacaggggtggcatgggtaaacaagtgktccgttttagaccaaactaagttttggatcccatttgatttctaagtgaaaatgctgaatgggaagttgagcctgggactcaggggagtcatcagagcta

SEQ ID NO: 3240 - DNA, 201 bp, Homo sapiens
tgctactggtcccaggacccctctctgagtaaccaggctctcagcctctgtgttacagtgtcccctcacgacctggagaaatgcttgctgtgatatgagtrtggagcaattgcatactgagagaataaacatggggagatggggcaacagataagtcttcccatctgctcacagaaactcagcataaacaatgttagagga

SEQ ID NO: 3241 - DNA, 201 bp, Homo sapiens
gaagaatcttgaacaatcttgaggcatagaaagagaaaaaaggacccatggtatcctagaaattaaaaggaagatgataataaagagtgaatggtaagaartgctaatgttgggcattggacctattaatggcaagaaaaaccagacacatccactgccctcatggagtttataatctagtagagagctacacataaatag

SEQ ID NO: 3242 - DNA, 201 bp, Homo sapiens
gtcagtctctcaaagtgctggtattataggtgtgagccaccacacccagcctgaattttttaaacgacatccctaatgagagctttcaaaaaaccatctcrtttggcacttagtgggccttttcctttttactggcatcatatttgctgaagggttaacaaataattgaatctactctttcgaagtacagtttaagctttc

SEQ ID NO: 3243 - DNA, 201 bp, Homo sapiens
ttaactcaatcagaattttactttccaatagaatagtgttgtaatgatattttggtgtttggtcttgagggctctctcttgagagtgatcctaagtcaagrtaacaactctctcggagagtcatgataggggaaatgttaggtttgagtgtgtgtttcaggtgagatacaatgagaaaatgaaaccaaaatgcgtgaaata

SEQ ID NO: 3244 - DNA, 201 bp, Homo sapiens
aaaattgggaaaacaaaaacaaaagcaaaatactgtttatgaaaatagaaaaatctctctacatgtattcattatgcagccaacagataatgtttctgtgmgtcctttgagcaaataggaaccatggttttaatgtttgggtgatgtctcataggtaaaaagctatggacctctggcacaaatacctggaacaaaaggtct

SEQ ID NO: 3245 - DNA, 201 bp, Homo sapiens
ccaacaatatctccctgaccacataactagtcttccagggatgctgctacctctgctgccgtctgaaagtggagactcagaatacttgtctatccaatagygttccagaacaatatcatttctattgttccccactgttccctagggctgccttaacaaattatcacaaactgggtggcttaaaacaataggaatttattc

SEQ ID NO: 3246 - DNA, 201 bp, Homo sapiens
cttccactgaagaacatgtctgggaataaattcattgagcattcagcaggcaatgtgcccaataggtaggggaatgtgtgtcctttcctgaagggggattygggcagtacactgcagcttgtccagagtgtgtccccctagaatccaccatatggatcaacttcttttctataatgtttattccatctcggactaactcca

SEQ ID NO: 3247 - DNA, 201 bp, Homo sapiens
tcacatgactcttccctgcaatccttttctactgaccttccagcctttctctttctagaccctgaccagccaatgcctattaaccatttatagtcaatgaytaaatcttgcctataaatctgtatacagtcttacctcaggctacttctctttccagtgaaaagataactggctgtatgacttgatagtctgtctttgatt

SEQ ID NO: 3248 - DNA, 201 bp, Homo sapiens
acttaagctcatcccaaggagaacctctgaagctgggatgtcctttctaagaaattccagattgaggcaagaggttgggattttgtagtttgtaaagaacwagtcactggatgcaggctgtctttgaggagaaaattattttgggcaagaaatctatcttccactgaagaacatgtctgggaataaattcattgagcattc

SEQ ID NO: 3249 - DNA, 201 bp, Homo sapiens
gaacctctgaagctgggatgtcctttctaagaaattccagattgaggcaagaggttgggattttgtagtttgtaaagaacaagtcactggatgcaggctgyctttgaggagaaaattattttgggcaagaaatctatcttccactgaagaacatgtctgggaataaattcattgagcattcagcaggcaatgtgcccaata

SEQ ID NO: 3250 - DNA, 201 bp, Homo sapiens
caacccccagcaccagtacagagcaggtaatgtacttattcccccgcattttttgggtctgcagtaatatgatcagatcactgcttcttatattgtacttycccactctttgttgattatatctttgcttgtctagcttccccaccaaatgttgtcaggggttcttagtaacaggagttctacgtcagattccccatgaaa

SEQ ID NO: 3251 - DNA, 201 bp, Homo sapiens
tgtctagcttccccaccaaatgttgtcaggggttcttagtaacaggagttctacgtcagattccccatgaaatagactcagagactgacatttgcaagcasgagttttactgaagagtgctttttgggaaaaaaaaaatacctaaagaaatcatgcaaatcaaaacacctgagagtaatggaagtagagttggacagaaga

SEQ ID NO: 3252 - DNA, 201 bp, Homo sapiens
ccacaacacacagtggtttaaaacaacagacctttattctctaacactttagaggccagaagtccaagatggaaataatggcaaaattgcttctttcttgrgggctcagtaagataacttatctcatgcctctctccccatttcccatcatttctaatcatccttggcatttcatggtgtgtgacagcatgactccgatct

SEQ ID NO: 3253 - DNA, 201 bp, Homo sapiens
gtcatatttccttgaaggatatttccacatggcagacttgtgcattcaggaaaaagcaagatgtcttcttttcttattgtctcataatccacatactgaartagaagttaaaaaatgtaaactaacgtgacttattccaaagaaatgaggggaagatacatatattattacaaataaatctagaccattttggcaaacagc

SEQ ID NO: 3254 - DNA, 201 bp, Homo sapiens
cttcctctgtcactactcagtaaaatgatgcctttctgtcttttgtttattatgtctttttccagctctgacaaattctttcaaaaagttattcatttgcrcttatcataaggtagccaaggttaataacttctttaaagcaattctagagttctttttatttacacaggaacatacacaccacagcagcacacatttaat

SEQ ID NO: 3255 - DNA, 201 bp, Homo sapiens
acagaatcacagcaaaaataacaacagtaataatattctgcataaacaatgatttaaagccagaattgggagttagattttaaaccaagttctgctgcccrtatggggttaggtcatgtttatacttgtcactctagtttagcccgggccccggtactatggtttgaatgtgtcccccaaagttcatgtgttagaaatttg

SEQ ID NO: 3256 - DNA, 201 bp, Homo sapiens
aatacgatataaacagaaacaacataaagttcaaaaagcaaggggatacaggtaaagtgtagagtttttattaattttctctttgcttgtctattggtttktgcagtcagggttaagctgtcaccagcttaacataatgttttgttattttgccagcctcatggtaacctcaaatcaaaaaacctacaacagatacataaa

SEQ ID NO: 3257 - DNA, 201 bp, Homo sapiens
caatgatgtcattttccataaaaaagggttccgtgagaacataacaatcttataaatgaaacaggcccagctcatctggtgaactgtttgttacacatgaratagtaccagatgctttataagaaggtaacatggtacaggccgacaatgttattttgaccagattatttatgtttcattcattcatccagtgctttctct

SEQ ID NO: 3258 - DNA, 201 bp, Homo sapiens
attctcttcatcttgacaatgtgatttgttatagaccaacaagtttatactggttgcttgaaaaagatgagactatgtagaattattatatttcttatatygcaagacatatagaatttgtaaatgaaattcatgagcttgcaactttttagcaagatactgtgacccataatacagaggttcaactggcaacaaatcagt

SEQ ID NO: 3259 - DNA, 201 bp, Homo sapiens
gtaggaaaaaaatcttttctacaaatggtgctggaacaactggacactcacatgaaaaaaaatcaaaacttagactttacacacaccttttttgaatgttmactcaaatggattctatgcttaaatataaaatggaatactataaaactcctagaagatgatgtaagagaaaatctagaagatctagggtatggcaatgac

SEQ ID NO: 3260 - DNA, 201 bp, Homo sapiens
gttcaaccaaagtctatttttcaaaatgatgtttaaaacatattttgccaaagatgcttggaaaataacttagtgaaatattactctgtggagctaaaagwttctgggcgcaataaatctaatataaattttaaatatggcatttttctactaatgtttatatgtagaagaacttagacattgttgctgtgtggaaggctt

SEQ ID NO: 3261 - DNA, 201 bp, Homo sapiens
tggaaatgtgattaatttgtctcaccatgtttatggagttaataaaactgcttaaaatctatcacttatgttaacttcttagttaagtcctccagcacctsttactaaccactttctcccaaaatatgttacattttaccaaatttgttgttttttgtgtcttccgtattttgtgctattttaaactaatatatattcttg

SEQ ID NO: 3262 - DNA, 201 bp, Homo sapiens
actatcaagttatctaatttttagagatcaaaagatagctttataacgccccttctatttttcttaggatgatcaaagggattatgaagaaaatgccttgraaaagttgaaagtaatctatttatataatgaataaattattgttattttgggataaaatctattgcttttatttaaacttggaactttgcttcaaataat

SEQ ID NO: 3263 - DNA, 201 bp, Homo sapiens
gtagcatcaacatctccagggaggttttcatagattcagtatcttaggccccactacaaaatcaggatctgcattttctcaagatcctcagataaattgcrgaaacattcatggataagaagcactaatataaggaatgtattcaatgtgggttcaaaaacattgatgagaaagatgaaattcttggatttttatcttatt

SEQ ID NO: 3264 - DNA, 201 bp, Homo sapiens
ggtggaagctcctccaaggaattcatggaggtaaccatttcttacatttacatatcccctcagtgattagtaaaatgctttatgtgtagatgatgtccaaygaatatttgcttgagcacagtgcttatatatttccagtttgttaaccagaaacattcgacaataacaatttattttttcaataatcatttgtttgtgctg

SEQ ID NO: 3265 - DNA, 201 bp, Homo sapiens
caaaaagagttaaattatactgaggaggccaggcgtggtggctcatgcctgtaatcccagcactttgggaggccaaggcaggcacattgcgaggtcaggtratggagaccatcctggccaacatggtgaaaccccgtctctactaaaatacaaaaaattagctgggtgtggtggcgcatgcctgtagtcccagctacttga

SEQ ID NO: 3266 - DNA, 201 bp, Homo sapiens
tggaaggtagaaggagggagaggatcaggaaaaataactaatgggtactaggcttaatacctagtgatgaaataatctgtacaacaaaaccccctgtcatrtttacctatgcaacaaacctgcacttgcacccttgaacttaaaagttaaaaaaaaggacattgaacagtggatgagcacctcaaaaagagttaaattata

SEQ ID NO: 3267 - DNA, 201 bp, Homo sapiens
gtttcttgcagggacatggatggagccattattcttagcaaactaacagaaacagaaaaccaaatgccacatgttctcacttataagtggtggctaactgrtgagaacacatggacacatagagaggagtaacacactggggcctttcggagggtggaaggtagaaggagggagaggatcaggaaaaataactaatgggta

SEQ ID NO: 3268 - DNA, 201 bp, Homo sapiens
gttaggcctttttgctctttcatccttttcaccatgtgagtaaggacacaacattagtctcttccagaggatacatcaacaaggtaccatcttggaagcasagacaggaccctcaccagataccaaacctgccggtcccttggtcttagactttcagcctccagaactgtgagaaataaatttctgttctttataaattat

SEQ ID NO: 3269 - DNA, 201 bp, Homo sapiens
ttataatcctgtgctatttagaaatgtcaactgagtagtgacttagaaaaaaactgacactccattttcttatctttcttttaaatgtcatactgaagagsaaaatacatgtgggccagagggtattttgagttgtttttgaactaaggtttttatatattgaagtcaatatatactttggtctcatttatatgataacat

SEQ ID NO: 3270 - DNA, 201 bp, Homo sapiens
ttatgctattatgggctatgttcataaaccactcaaagagctacagaaaatagaatgaagtatagtcctttcatgatcacttgcccttcttattgctaaargaaccaacagagcaccaaagagaccttatagctgttcctcaactggagtagaccaggctattccctagttcaccctggtagcaacagccagctttcttcc

SEQ ID NO: 3271 - DNA, 201 bp, Homo sapiens
ttacataaacctagatggtaagcctgcctaccacacacccaggctccatggcatagactatcacttctggctacaaacctgtatagcatgtgactgtactraatacttaaaggaactgcaatacaatggtaagtatttacgcatttaaacatagaaaaggtaccataaaagtatagtataaaagataaaaaatagtacatc

SEQ ID NO: 3272 - DNA, 201 bp, Homo sapiens
aggttgcagtgagccaagattgcaccactgcactccagatagggtgacagggtgagacctcttcttgaaaaaaagtttaataaaataaatagttaagaaarcatctgaaatgaaaactccctaaggagtgtcatattgtgctttctaatatttttattactataataatagtatgtcatgttgctgtttgcatgattttta

SEQ ID NO: 3273 - DNA, 201 bp, Homo sapiens
aggagtttgaggccagcctgcacaacatagtgagaccaactacctacaaagaagattaaaattttaaaaattagaaaaatattagccaggtgtgattacamacacctgtagtcctagttactcaggaatctgaggtgggaggattgcttaagcccagaaggtcaagggtgcagtgagctatgagtgttcaaatgcactcca

SEQ ID NO: 3274 - DNA, 201 bp, Homo sapiens
cacaagttaagtcccactggcttagaattccagccagctgatggcaacagactggaatctgcctgagatgggtctgagttcccagggaggatgggcaggcrccatctctgcagtttggttgactcagccattccagcctgccagctctggagaatacaaatcgtccagagaaggaagggcaccccctagaacagcacacct

SEQ ID NO: 3275 - DNA, 201 bp, Homo sapiens
cctggtgtaaataaattagcctaatcctgtggctggtaagtcatggagctgtggtttaagagaagatttgtttcactgcaaagcccactctttccactagmaggagaatgagcccaaaggtgtagcttgattctgagctgaaggtgttctacatgaggatgtgctaaggatggcctgatctggccagaaccaatctgagaa

SEQ ID NO: 3276 - DNA, 201 bp, Homo sapiens
gtgcctaaaataattttatagttgattatatgaaggcatattctctctgctgagactgggttatctacctaaatacatattggaactgctcatatagtttyctgatagataacttggcacattttctttggattttagtgtgttcaaacgtttataatatattatataaaaagagaaaaaactacacttcactaagcatga

SEQ ID NO: 3277 - DNA, 201 bp, Homo sapiens
ataaactatttagttttaacaatatagaaatacttttcctgaaaagcatattaaaaaaaaaaaacagaagcttccagtttatttattttagttttactctsttcacataccaacagctacaactttcctccctttgtggggtccccaaactaagtctctttccaggagaacagacacatgcctccatcagctctgaggact

SEQ ID NO: 3278 - DNA, 201 bp, Homo sapiens
gggtataactaacaaaccaattttgagagaggaaaaaatgtaatttccagaaaaattcagagatcattgtaccagctaaagttttaaacatgcagaagaayaatctattctttagggatatattttacaaaaatatacagaaacgtgttgaaagtataactttaaatatggtgattttcctttgatggaagaagcaataag

SEQ ID NO: 3279 - DNA, 201 bp, Homo sapiens
tgaatgtttatagacatctgcactagaagctgctactgaattttaattattcttctcctgagaacatgaaagactacattacctagcccctaacatttggraagtcccctatgaccacttcaagacaaaaatctgagaaaaaaaaatgcgtgtgacttttacacttaaacacagaagaatgaatgtgagatctccttgtat

SEQ ID NO: 3280 - DNA, 201 bp, Homo sapiens
atgtaatgagatgacttagaaagaaaacaggtgttgattggctattataattacttttctttcttcatagtcacattatgaatcctatataaatgtacagytgagtaacaatatgaaagattgtcccagaaaaagagaggatcataagcttagggtaggaggtagagctgttgtatttgaaagtatgggacgttttcttct

SEQ ID NO: 3281 - DNA, 201 bp, Homo sapiens
tactatttgttttttttgtataaaaattcttatgaaaaatatttggaaaaatcttcccctgagtaaataactctgatttaacttaaaattgctctatgctrttttgagaattctgccagattctggtagttacttttttttgagaacttcattaatttacttggataaaacaatatttatttttcaaaatctggtgccgac

SEQ ID NO: 3282 - DNA, 201 bp, Homo sapiens
atcaacccgtcttccctctgtacatctgccacaacatatctgatagtcagccaaaagcacttctacctctgacattagcaatgttgacatctctgcctatwagagagaattccagatttttttctcccaagtcaactcctcccaagtttcatgatcttaggaaatgatatcattttcacccatagagcaagaaaaatactt

SEQ ID NO: 3283 - DNA, 201 bp, Homo sapiens
ttctactcaattatttgcatcatccagcccacacgatagcataatcttgtcatcgtctagtacattctgggaaatttagtttttctcatgcctccatccarttcaatcctcctcactgccagctggcttctaaccattgttctcagctcactggagatttgctactgtcccagactgaaattcccattgcctttattccac

SEQ ID NO: 3284 - DNA, 201 bp, Homo sapiens
ttatgggatgcctgagaaccttgatccatattatacgcccttctaattttcatcatgtggctttggttttttcagactatcttatttccccaagatatgtsatgttttgtgctctgtgtaaataataattaaaatcaagtcaagattatatgtagctagttgtgcctgactcactcaagggatatgcccctgaaagatatt

SEQ ID NO: 3285 - DNA, 201 bp, Homo sapiens
agagacaattctgcaattttgtgtaatctatttactactctctacttcagcattcatttacctaaaagaattagggcctattatgtgaaaaaataacaacycattgcaagactgcttctgtagataatgatctcaatgtaagaggggcagaataggtcaataaatctgtttccatatctcactcgttcactacctggatat

SEQ ID NO: 3286 - DNA, 201 bp, Homo sapiens
ctactctctacttcagcattcatttacctaaaagaattagggcctattatgtgaaaaaataacaactcattgcaagactgcttctgtagataatgatctcratgtaagaggggcagaataggtcaataaatctgtttccatatctcactcgttcactacctggatattggccaggctactcttagggatccccgattattt

SEQ ID NO: 3287 - DNA, 201 bp, Homo sapiens
cttatatgaagatctaggaaaagactcctagccactagagatgttttgtcttagatagagatggactcaccgagtcagatctcactcaggagtctgaatamaagacaaatataaagtgttagaaacagctgatgatgagggcaaaacccaagagataaaatattaaactcaaactacatggcagtaaatgtcatgttagct

SEQ ID NO: 3288 - DNA, 201 bp, Homo sapiens
caagaaaagactttcctgagaacttagactaactctgagggtctctagtgggtggagcttgtaccaatttaaggaagttgacaagaagcagtgttggattyactttgagaaagaagtccataatgaatactgccatcctataaaaaattgattgccttttaaagcaatgaactagataaatacctgccaaagagatatgga

SEQ ID NO: 3289 - DNA, 201 bp, Homo sapiens
tctcctttttagaggagaggaggaggtttaattcatcctttctattcttagatacaagtttatttgagagttttctgtttatattcataacactatgaggyagcaatgaaaatattgcctatcctaatatgcactagagcctcatgtggatttttatctcataaacatttttcagcatttttagtaaagaaacataattct

SEQ ID NO: 3290 - DNA, 201 bp, Homo sapiens
aatagcaaatctctgttaatacagactctgaagaaaaggatatgctaaatcatagcctgacatatctaacttgtgttctctgttatttaagtaaacaattscctctagcagatgcatataaagataaaattacagcttataaatactcatttctcttttacaaaatgaatggagaggcatatcaagatcagtgatgaataa

SEQ ID NO: 3291 - DNA, 201 bp, Homo sapiens
tggccaggatttagtcttaggtcttcacatacattttagttacttaatgttcttgaaaacctacaaacaaactggttaaacaagcaaagaaataacagacrtaaaaggagaacgtttgcttttagttaatgttttcaagatttatttattcatttaaatcaattattaattgagtgcgtactaagcacaggaatataacag

SEQ ID NO: 3292 - DNA, 201 bp, Homo sapiens; identical to SEQ ID NO: 1524

SEQ ID NO: 3293 - DNA, 201 bp, Homo sapiens
ccttagtagctcatccatccacccaggagccctaccaagtaacgtgtggcccgcagactcatggcgcacgtgtcccctgggagctggctagaaaagtagayccggattggacttgccaattcacagtctgcattttaacagctgctttgggggttgggggatccatgccagagtctgaaaagcccagcccctggtaaatca

SEQ ID NO: 3294 - DNA, 201 bp, Homo sapiens
aataaaataacttaattcttaagcatcagcactgttcttgatttctctacatagccaaggtttaggcaatttaactatgacattataaaatagaaaaaagwagccatctgattttttaaacggagattcaaacagcttatataattttagtttgtggtatttatcttggtttgacaatgcagtgtagcttcaatttaacat

SEQ ID NO: 3295 - DNA, 201 bp, Homo sapiens
ggaattgctcattcttagagtaagtatatgcttgactttattttcaaaatgccaaaagattttcaaagtgaaatacatgagaatttcaacaatattgaaayttgaattgctccacatgttcaccaacatttggtattctaagtattcttcgttttagttattgctgggtcttagtggtttccccttgtggttttaatttgc

SEQ ID NO: 3296 - DNA, 201 bp, Homo sapiens
aacagcattgctcttcaagtttgggtatctgaacaagagtgcctggtacagatggcgtttgttggttagaggaccacagcatttgtggagtacaggccaayagcatttagaggtagagctcacagccaggaacaccacacacgggacacttggcctggctgtgcttatgagggtctgcagccgcacgggagcatgtgacgt

SEQ ID NO: 3297 - DNA, 201 bp, Homo sapiens
tacaagtttacctacacaacaaacctgcacaagagccctgaacttaaaataaaacttaaaaaacatgcagaatctctggtcccaccccgaccttggactcrgtcttcattttaataagctccccacaggatctgtagttatcttaggatgtgaggagccctgccctgggagattttatgtggacagcaaagtgaagaagtg

SEQ ID NO: 3298 - DNA, 201 bp, Homo sapiens
gatttgtttatttctcccttcagttctgtaagtcagggcttcttatattttgaatcagttatttgctgcttatgtgtttatggttgctttgtcttcctgayaatttgtcctctttatcattgccaaatgtccctttaaatccctattaccatttagttttctacatctattttattacctatattgtcactgtagcttttt

SEQ ID NO: 3299 - DNA, 201 bp, Homo sapiens
ctactttgtggatgagaaactgagattaagaaagagtaagtgatttttccccaagtgatctggtgtgaaggagccaagagtcaagctcagacaatgcaagygacgcccatcccggcttcactcagcagcaggaccaggccttcccttctcctgtgcttccagggtctccagagcttagaaagtgcacaacaaagtccatgc

SEQ ID NO: 3300 - DNA, 201 bp, Homo sapiens
ggctgtgagagcgcagagccctggaagcaatgagccgaggtgtatgcggggacggagggaccagtgccagggatcctctcgcagaaggctcaggacagcawgacttccctttatggaacacatggctagatggagggccttttacagacagcgtgaggagaagaaaaactggagacagtgaggatgaagtatgagacgtat

SEQ ID NO: 3301 - DNA, 201 bp, Homo sapiens; identical to SEQ ID NO: 2153

SEQ ID NO: 3302 - DNA, 201 bp, Homo sapiens
caagtttgaatgtctttcattatatctctgctagaaataaagactttatattaaagtataaccattcataaatgggagggtaggtggtgtacaggctaatstatttgtagttttatatcatagtgtagggaatgaagttaaaattcattactgtgtcatttaagtaaacaattctgaatctaacctaccttcctttagaac

SEQ ID NO: 3303 - DNA, 201 bp, Homo sapiens
agatttctcacacaactgtggaaacgccctgtttcttactgaatgaacttcataaaacaatgaacctcataccatagaactactcaggaagacttgatatkgagcccataaaaatgtcagggtttatttattagttgtttcatcacagtaatctcaagaggaataggaaaaacatgaaagaaaaaaggaataagccactga

SEQ ID NO: 3304 - DNA, 201 bp, Homo sapiens
tataattgctgccttcctatatgagacatgaaaataatgttttgcaatgtaagttagatttttcatggtgtagcacctcactcctgtataaagttatttcmtgatcagaatattctaaactatcctgtggcaataaactgctaaatccctgtgtctttgctcattaatgttttatttgttgatcacttcacagctttccac

SEQ ID NO: 3305 - DNA, 201 bp, Homo sapiens
ctttccgaatgtagatgtcaagtgtattttacttccctgatttctggctctgtgtctcttactagctgttcctttgatgctatctggaaaaaaaaaaagayagaagggccatcattaacttgatctttcattgggggtcactttactagaccaagattcttttactggcctattttgtataaaatcttatgtcagacatat

SEQ ID NO: 3306 - DNA, 201 bp, Homo sapiens
atcagaatattctaaactatcctgtggcaataaactgctaaatccctgtgtctttgctcattaatgttttatttgttgatcacttcacagctttccacagytttctccattaaacgatgattctgtgacttcttccttcttgtaactttaccatctaactcagtgcttccaaggaagctttgaagggggaaagggaacgga

SEQ ID NO: 3307 - DNA, 201 bp, Homo sapiens
aataaataagttgtatggctgaagtttgaacatgggtctatctaaatttaattaaccctctgaagcactatatcaccctaaacaaagtggagtattttacrtatatcctgattgcatgatgaaataatgcccggaaaacaagaaatatgcatacacacacacccacattcagaagttagcattaataaaatgttaactaga

SEQ ID NO: 3308 - DNA, 201 bp, Homo sapiens
ttaatattgtaacagcaaatatgtggaggggcttcactaaatgaatacaggtggaccttgtcccagaactgaatgattgttttaatacgtgagtttgtggmgatgaactgagaatgtaggaatcctattcttttttgccgaacctgctcgattgctggagacacactctctgtgtctcaaaagctattacagtctctgcct

SEQ ID NO: 3309 - DNA, 201 bp, Homo sapiens
ccctaaacaaagtggagtattttacatatatcctgattgcatgatgaaataatgcccggaaaacaagaaatatgcatacacacacacccacattcagaagwtagcattaataaaatgttaactagaatttttttttctcattcctttgttcatgcattcaactacttattcattcatttatgctattatgcatctacttta

SEQ ID NO: 3310 - DNA, 201 bp, Homo sapiens
catcacagtaatctcaagaggaataggaaaaacatgaaagaaaaaaggaataagccactgatacagtgggcttaagctttgatgtgcaatgtggaatgctyactgtgatatttattctctgtcccaatgaactgggaaatggggatggagtccataaatctacgtggttttaaaccacctcaaaggtgagagataatttaa

SEQ ID NO: 3311 - DNA, 201 bp, Homo sapiens
actgaatgattgttttaatacgtgagtttgtggagatgaactgagaatgtaggaatcctattcttttttgccgaacctgctcgattgctggagacacactytctgtgtctcaaaagctattacagtctctgcctcagggaaggtggcctgctgtggggttggtaagtgatgccaatggctgtggttggatttatattcaat

SEQ ID NO: 3312 - DNA, 201 bp, Homo sapiens
tgggattacaggcgtgagccaccacccggccaatctatgtctttttaaaaattatcatcagtaaaacagtgcatttaaactctgtacaacatgagttttamctgcaagtgtccacttaaatgcaaattttcttctgcctctgccatccctgagtcagcaaaaccaatccttcctcttcttcctcctcagcctactcattat

SEQ ID NO: 3313 - DNA, 201 bp, Homo sapiens
tgggcagcatttgagtgacagtggcagattcctcatgaatagattaatgccctccttcaggcgtgagttcttactcttagttcccaggagagctgattgtyaaacaagaaactggcaccttatcctctttctctctcttgcttcctttctcaccgtgtaatctctgcacattccagttcctctttgccttctaccatgagt

SEQ ID NO: 3314 - DNA, 201 bp, Homo sapiens
ttttcatagttttcatattctgcctttccacctcttctttttaacaagtaaaattcctcatagcatacaaaaaaccaattttataaaaaacccatattatmgatcagggacctgtggattatgtgctattagaaccatacaaaatgtctctatatagttttctgtatctttggaatatctttgggtgaagctgcagacctt

SEQ ID NO: 3315 - DNA, 201 bp, Homo sapiens
ccctgggggcctgactacatctagggggcttgaagtgtcaagagcatgtcatggggtcacagatgacagagacaaaagagtttgtcttagaactaagatarggactgaatagcatggattacgatgtttttggggagtcaaagaatgagacactctcagtttaggggtggggagaaatagaaacaggagatttttaaagag

SEQ ID NO: 3316 - DNA, 201 bp, Homo sapiens
agttgccagtatatagatggtatttgaagccatgagatcagatgcaatggccaatggagttaggatatatgaaaaagagaggacaaataacttacttttgygaaaattcaacaataataagatgtgaaagaaatgagaagaagtaattagtgtaagtttttatacaatctgttttctactcttggctaaatatgccaagat

SEQ ID NO: 3317 - DNA, 201 bp, Homo sapiens
tttggatcttcttaattgagagaaaaagacaaagattagaatttctgatcgggcttgatttgtttagatataaccatgcttcagaagtatttcatacatamaacataattctgtagaattgatttattttagcaacatgggaaaggaatcaggatgggaacttacatttattaaatacctatcagctgcactcacttggga

SEQ ID NO: 3318 - DNA, 201 bp, Homo sapiens
gtgggtcctttgttgagaatggatacacggatggatgaatgggtagatggcagatagatacatgcatggatgacaaagtgtttaaaaatccagaaagcctygtttgagtaaaaggaagagttaatatcaggcagcaagaaactgtaaattttggcttcagcagtataaatattgctgtattggggcctaaatagattttct

SEQ ID NO: 3319 - DNA, 201 bp, Homo sapiens
tattatttttaaagtatatcttacatatttcaatgtgttgtttaatcgagttttctgaaaaaaaaaatagacatttttattttgaagaagttatcacctaratcacatttatgtacccaaaacaatattggctattctttacaaaaataaccatggcactcttttaagtgagttagagaaaattcctaattttattctaac

SEQ ID NO: 3320 - DNA, 201 bp, Homo sapiens
gcactcttttaagtgagttagagaaaattcctaattttattctaacaaaaactaaatgaaataggtattcttattttctgcttgacagacaaggaatgtaragcttagataggttaaattgctgtccaagatcccacatgtattagtggtagaatttaattgtagaatttaattagaggagtacctgctgtatatgtaatt

SEQ ID NO: 3321 - DNA, 201 bp, Homo sapiens
atatctcatttgtcatttgagaatgtttgtcatataattcaataaatttactgtcatctgaagagaattcatgttttaattattggttttggcatatgttwcttaagagaagatttatgttttatgtttcttaggaaaagattaattgatacattttgaaaggtagattttaatgctaattttgtgaggctcagtatttgt

SEQ ID NO: 3322 - DNA, 201 bp, Homo sapiens
gtctcattggcttacaaaacaaaaggtttattggttactttagacaaagccagctacaggtcagctagagctctgctcctcggggcttttcagtccagaastcaggcagaagggacagtcctaatcagggatatgccactctgaaggcaaggagagaagagcaagaaagttgaagaattagatttagatatttgcttgggt

SEQ ID NO: 3323 - DNA, 201 bp, Homo sapiens
tagaagctggagtcttttccctcatcatttatagtagctgtacatacagagtaaccagcaatcttgggcaagcagtcagaacagtcagaacaaacgggctygatccttcctccaatggcttcatgcaatgtatttctttctttcttaagaaattccctataaaacatcacattcatgaagtatagaaacatttcatgggag

SEQ ID NO: 3324 - DNA, 201 bp, Homo sapiens
ctgagaaaaaaatcacttcttttaatttttaaatttgtctgttcagtttcaaaatcttttttattttgtattagaagttatatctcatttgtcatttgagmatgtttgtcatataattcaataaatttactgtcatctgaagagaattcatgttttaattattggttttggcatatgtttcttaagagaagatttatgttt

SEQ ID NO: 3325 - DNA, 201 bp, Homo sapiens
tatccgatattatattttgaaagttgtaaagttatactttattgactttccagtttttaatccatctgaaataaatcagtctgcatgttctgaggtagaawcctaattttctattgttctgtatgaaggaataattgccaaacaccatttattagagtagtctgccccatttagagatcaaagttgcattagcagcataaa

SEQ ID NO: 3326 - DNA, 201 bp, Homo sapiens
acactggaaatttctgacagcagaggaggtatgggttctgatatatgtgtgaggtccaactttatagtccaagtatgtaggttcaagatatatatgggagktagactaataagtttttagcaatagtttccatattttatatagcaaggtaaggaagaaggaagaataaaagatcactcccacatttctaatttgaacatc

SEQ ID NO: 3327 - DNA, 201 bp, Homo sapiens
ttggctatttattttgcagggtatccaccaatttcactctaatgtttctatgtttaaaatgtatcctgatcaaaattacaagtacgctttcagtctgaggwtgataaacattcttaattacataaaattcttatcaattatataattcaatattgtattttcccaatccacttccttatctcattctgaaagtgcttttag

SEQ ID NO: 3328 - DNA, 201 bp, Homo sapiens
aaccgtggcggtagtggtgttacagttcaaaggggtgctctgtgtgttaaggtctttatatttgcatattgtaaacagtctgtatttctcctgaatgaaarattggctaagcataaaaccctgtattggctgttattatcaattgtttgcaatatccattggtgtccattacaggcatgctgcttctctagtaattgttaa

SEQ ID NO: 3329 - DNA, 201 bp, Homo sapiens
ccccgcctcggcctgccaaagtgctgggattacaggcgtgagcccctgtgcccggcctattttgactattttctaaccgtggcggtagtggtgttacagtwcaaaggggtgctctgtgtgttaaggtctttatatttgcatattgtaaacagtctgtatttctcctgaatgaaagattggctaagcataaaaccctgtatt

SEQ ID NO: 3330 - DNA, 201 bp, Homo sapiens
attaccaaactgctctcctgatttgttagtgtttcttattatttatattttctagactatttatatagatattttaattttaatcaatatgatgcctatckaatgagactgctttcttttctgagagttgcttatttctaccctttccccattattttcttgtgctacatgtctttttctttttttctttttagaactttc

SEQ ID NO: 3331 - DNA, 201 bp, Homo sapiens
ataagccctatttttttctatgtttttttgttaaaaaaattctaaaaaataaaattattctcacctttaagggatttaaatattgtagagggtaaaagttyatatctgtgtttgtgtagtcactaaaatagttcgtattctgtaaaataaaatcataaaatagttgtattataaagggattgctaaaaagacaaatcagtg

SEQ ID NO: 3332 - DNA, 201 bp, Homo sapiens
agtaattcaaatgatgaggactaatttaacaaaaattaaagcacactctgtattatggtaaaatacatttttataaactgttaaatttcaattttatatamctaaaatttagacattataatagtgttttgtaatctattattgcaaccttttagattttatactaataaacatgtagaatttcaatccatatggtttccc

SEQ ID NO: 3333 - DNA, 201 bp, Homo sapiens
cattaaagcatgaagcaaaggaattgcaaaaagaaaaaaaaagttaacatctaaattcaggtctaaataaccttacaaaaaagaattcaatggtggtaacwatctctgtcatgtttaggtaggtatataatgcagttgtaagataaactatatgttaaactttagcatataaaagagaacatcaaatctttgatgttccta

SEQ ID NO: 3334 - DNA, 201 bp, Homo sapiens
cagtagttcagtttcagtaaaaagcaggttgaaagaagttcactggaaatgattgctaaatcctttgctagaataaagtacaatgcaattttggtcaaacrtgtcctgaatctgttgttttcagtttagaatccaagcatccttgagaggggtcacccatgtacatgcagcatttacttggatggaaattacacatatact

SEQ ID NO: 3335 - DNA, 201 bp, Homo sapiens
tatcaatacttctgaggaaagagactcaaaaagtagaaaaaagaatttcctttcaaaaaaggtatttaggtaatggtgtgctggagctgactcgcacaagygcttcagatacaactgtgtatatctcttttcaattgtgtgtagtgtcaccatgttgatggtttgaagtcagccacagtatttataccgtgtaaactacag

SEQ ID NO: 3336 - DNA, 201 bp, Homo sapiens
atggagatgaaattatatgttaatcctaatatgtgttttgtctactaacataatagccaatattatagctattaaaaattaatctttgtaaagtacatttwacattaatttatttaaatccatttcatttcctaaggaacccacagttttttacttgaaaattttctcaagtgatagtgtaaacgaacaagtgaaggcaaa

SEQ ID NO: 3337 - DNA, 201 bp, Homo sapiens
tctttgaaggtaattttttttctcttgtttactaatagaatcctctgattcctctactgtacaaactagtcattttcctttttacgtaacttctcttagaycatactggccattcagttcttttttaaaaaggagagagagagagagagagaagcttttaatacctttgaatactttccctgacttactacaggtaactgg

SEQ ID NO: 3338 - DNA, 201 bp, Homo sapiens
attatgtatttccagttctagaaatgaagatcatcttaatatgctcaagggagttttggtctaatctggacttttcttccagatgctgtggacatttaccrtaccctcaacaactatctagtctaaccagatctggccgtcattagattggcccagtatttcccacatatttgactggattgttcatctttcactttaagc

SEQ ID NO: 3339 - DNA, 201 bp, Homo sapiens
ttgtgaaataataaatgaaatattttaagaaggattgagcaatgcattaattcttgctaacctctgaacaaataaatcatattcatttcagcaagatgtgraagttgtgtcatgtcgcagaatgtgttttgtaaacaaattgaattatttgactaatgtgggcaaagaagagtgataacacattaagcggagagtgagtga

SEQ ID NO: 3340 - DNA, 201 bp, Homo sapiens
caaagttgcattagcagcataaaatgagttctgtagatctccatcttttttctacttgttgaagtggtgtctataaaaagtgattatctgatccttgaaaktttgacgagtacttttaaaatcaatttgttaaacaaattttgagttccaatttaatttaattaataatttgtgacttagtcacattttctatttcatctt

SEQ ID NO: 3341 - DNA, 201 bp, Homo sapiens
gcttttataaaaaagacaatgacaattatagtataataaatatcatatcctgttcactctctattatgttgtgggtggcagagaggtggctggcatcacayttttctgtacctttatgtttataatttcagtaagctacatgagctgaaatatttaatgcttgaattatttgcacactataaaatggttttcatttgcaat

SEQ ID NO: 3342 - DNA, 201 bp, Homo sapiens
attcttaattacataaaattcttatcaattatataattcaatattgtattttcccaatccacttccttatctcattctgaaagtgcttttagatatgtggyagaacttcttaatctatcctcttaatttctccttaattaaaaaaatatattttttggcttacaatgggagattctttatgagttcctcagtgttagcttc

SEQ ID NO: 3343 - DNA, 201 bp, Homo sapiens
tccaaagtccgttttctaattccaagccatctttggtcattcatcccctttattttgaaacgaaaatattggaaagtagtggtgtggaaactttacaacaratagggacagaaacatggtcagagagataaagccattaagatcatctaaactgtaaactcatttttgtcagaaattgtggcatcttactcatctttgtgt

SEQ ID NO: 3344 - DNA, 201 bp, Homo sapiens
acaccaacatggcacatgtatacatatataacaaacctgcatgttgtgcacatgtaccttgaacttaaagtataataaaaaaagcgaaaaaaaagaaatayttgtaatgtcagaaagttgaggcatgtcgaagaattgtctgcgaaagtcatgaaagagaaaaatgttataaaaaagaatttatgcaaaaaatgttgtata

SEQ ID NO: 3345 - DNA, 201 bp, Homo sapiens
ctgcctttgtacatatgcaagagtatcttttagatagatatctaaaagttaatgtcaggataagaatttctgatccctaaaatgtgaatatcttaaatatyaccaaactgctctcctgatttgttagtgtttcttattatttatattttctagactatttatatagatattttaattttaatcaatatgatgcctatcgaa

SEQ ID NO: 3346 - DNA, 201 bp, Homo sapiens
ttttataaatgctttaaatgagatagtaaaatatatcattaaaatagagataatagtcttttgaggaaaattaaatggacttggattaaacctagagaatrctgtaactctaatatgctttattgcataaattataagtaattttacaacacaatgaattgaaaagaaaagagcattaacaaattatgtctttagaccaga

SEQ ID NO: 3347 - DNA, 201 bp, Homo sapiens
tccaatttatccatatttatgttattgatatcataactaagaattcgttgccaaatccagggttatgaagatttaccccatgatttcttccaaaagtgttratattcatgcttatatttatgttttcagtccatttggggttaatttttatatatggcataaggtagagattcaacttattttgcatttgaaaatccagtt

SEQ ID NO: 3348 - DNA, 201 bp, Homo sapiens
atgataaatttatggtcaccctatatataatgtcgtgggaggttgcctgattgcttcccctagtgtgatgcagtgatattcttcaaggcactggcttagayactggaaacagaaaagtagtattaaaacgatctctgcctcccagaagctcacagtgcaatggaatgaaaaatatttattaattaatgttatgggttcctg

SEQ ID NO: 3349 - DNA, 201 bp, Homo sapiens
ctggggtttgtagttttcattacatttgacattcttcagccattatttcttcatctatatgttttttctcctatttctctattctcgtttctttacatacyccaggcatatgtatattagatcacatgaagctgtccaacacctcactcacacaccgttcattttattttcagttatttttcccctatgtttcattttgta

SEQ ID NO: 3350 - DNA, 201 bp, Homo sapiens
ttgtatttactgttattaatcatatatgtgatctactgatcaactaattcttaccttcatacaaactatatttttgaaactgaagcctctttacatttagyaataaatcaagccctcatatatattgcttaataatttctgtggtgttaactctcccaccctggctgatttcatgctatcaatgtgatatcactgaaaaca

SEQ ID NO: 3351 - DNA, 201 bp, Homo sapiens
ggcaagaatgatgtcatctcagactaggtagaggctttgggtatgattcctgggtttttggtttgagcaacagaaggatggtggtgatatttagtgagatrggaaatattagggaggaataggatttagtgggaggtaatcaaattttactatctaatatgatatgtttgagatgtgtaatggtatgtttgaaggtgttaa

SEQ ID NO: 3352 - DNA, 201 bp, Homo sapiens
actaatccttggctagtttttggaaggcaatctcaaagctggatgtgatacaaacagaataggtattgggataactccagaaaaatttagtctttcattarttcttgcatgcatgcatgcatttattcaaaaaatatttgttgagtacctcctacctagccagcactatagcaggtgtcaggaatagacaaaaataataat

SEQ ID NO: 3353 - DNA, 201 bp, Homo sapiens
ccaatttgttgaatagaaacaaatacttcagcgtaacagttggttctctttttgctacccattttcagacagactttagaaatgctgaggctttggagaayaattttaacctaaatgttcaacagtagtatagatcattactggaaaagagtttgtgttccttttttaatcagatagaaattttaataaaagtattcaaaa

SEQ ID NO: 3354 - DNA, 201 bp, Homo sapiens
agtggtgtcagatccttgccaaccaacaacaaatactacactttctatatggagaggaataggaaagggatgaagaaagaggcctgaacatcactctgcamgagaaaacaaaaccagataaatgaaggttccttcctaatgttagtcatcacatataacctttttacagagactaaatgtatatctaaatgctgccttgtg

SEQ ID NO: 3355 - DNA, 201 bp, Homo sapiens
agcaaagtcagctaataagtgatgcaggctggtaacttctacagtgtggatacactggacaaagaaatgattcatgtcctgggctgggtgaatcaggatgygtgagatttcatcatgctactcagaacggtgtgtaatttaaaacttaacaattggtatttctggaattttctacttcatattttctagaatgtagttgat

SEQ ID NO: 3356 - DNA, 201 bp, Homo sapiens
ggatagaagatttgttcttactgtagatcttagcaacttcagcatatgatttttttttctttccttattaactcaaaacttctacatctccacttaaatgragcactttagggattctttttgccatatccaaattgccaggattactactctcatgcatgggccattattaagtaaactaagggttccttgaacataagg

SEQ ID NO: 3357 - DNA, 201 bp, Homo sapiens
gtgaatagtctcttcactctattgattgtttcctttggtgtgcagaagatttctagcttgatgtgatcccatttgtccatttttgctttgattatatatgmttttcaggttttactcaagaaatctttgtctagaccaatgtcctggagtatcttcccaatgttttcataaaactgacatgaacagcaactgaattgctgg

SEQ ID NO: 3358 - DNA, 201 bp, Homo sapiens
ggtatcatttaagtatccggagtcttgagacctttcctacatctggatttccaacatatgaaagctaataaattgctcatttttttgcttaatctattttyacttgaagttctgtcaattgtgatgaacagagagccaactaaaacaaaaatactgcaaatggaaaaatcctaaaatgtagatttgacagaatagaaaagg

SEQ ID NO: 3359 - DNA, 201 bp, Homo sapiens
tgggggaagcccagcagcaatggaggaaatgaggccaacacataaagtgaagcagagctaatggatgaaagaagaattctgatggtatcatttaagtatcyggagtcttgagacctttcctacatctggatttccaacatatgaaagctaataaattgctcatttttttgcttaatctattttcacttgaagttctgtcaa

SEQ ID NO: 3360 - DNA, 201 bp, Homo sapiens
tgtctacaaatatggcattcccatttttatcttccatctgggggaagcccagcagcaatggaggaaatgaggccaacacataaagtgaagcagagctaatkgatgaaagaagaattctgatggtatcatttaagtatccggagtcttgagacctttcctacatctggatttccaacatatgaaagctaataaattgctcat

SEQ ID NO: 3361 - DNA, 201 bp, Homo sapiens
aataaacatagaagttggccctcctagttttaaaacctgagaaagttgcatttgtcttatctgagttcctttccaaggaaaccagccatcaggcctcccaratagtagcaaggagctgaaagtcaccagatcactgcatttggacaatcagatgcccgacactttatctgttaagtttgcctaactgaccacttgcttccc

SEQ ID NO: 3362 - DNA, 201 bp, Homo sapiens
caaagatcatttccacgttcttctggtaatgaaactgagcaggtgtcccacagagctgatgttcgtggtttctttgaataaacatagaagttggccctccyagttttaaaacctgagaaagttgcatttgtcttatctgagttcctttccaaggaaaccagccatcaggcctcccaaatagtagcaaggagctgaaagtca

SEQ ID NO: 3363 - DNA, 201 bp, Homo sapiens
cctggtacaaggtgggtacccaaatgtgtgtccctataagacagcagcaaagaaactgttactcctcaaaaactctcatctccactgaatgggtataggamatagaatcttcctgtacttaagcaacttttaaatagcactttatacactctcaaaagatcaattacatcagagtagctatggcttgtgaaagtaaaaaag

SEQ ID NO: 3364 - DNA, 201 bp, Homo sapiens
aaaaatagaattgactacagaccgaacagcctgtgtttatggataactgagcttcacacctctcactgaaggtgagaaagtcctattgaagatgacaaagyccttatcacagtgcctggtacaaggtgggtacccaaatgtgtgtccctataagacagcagcaaagaaactgttactcctcaaaaactctcatctccactg

SEQ ID NO: 3365 - DNA, 201 bp, Homo sapiens
accttaaatggccatccaggcagaggctttagaagtaaattgtttacattgattcacaatcccataagcctttatagtaaactatcctctttgaatttacwaccttggttaattcagcagaaaattgctttctatttctgagacccgcttagaaggcttgagcagatttttttttaaaaaaattgttctgcgatgatgatg

SEQ ID NO: 3366 - DNA, 201 bp, Homo sapiens
ttgagggtggaggtggaggagggagaggagcagaaaaaatatgtactatgcttagtacctgggtgaccaaataatctgtacaacaaaccccagtgacctayataacaaaccttcacatatacccgtaaatctaaaataaaagtttaaaaaattaaagaaaatatgttatcagaattttatgaacagtcttgttaaaggaaa

SEQ ID NO: 3367 - DNA, 201 bp, Homo sapiens
aatgaagtaatttaatttttaaatatttattgactgataaattagtttgattatatttattgacctgcaaaacacttttgctaaaaaattacattcaaaartaactttcttaaaaataatatacatctgtacatattaaagcaaaattttaaaaaatcccattcattatctaaaattaaacatagactaagtaaattactt

SEQ ID NO: 3368 - DNA, 201 bp, Homo sapiens
gtagctttgatgccatgagggcattggtgcctcagtggtgatgcctcaggttagctccagatggagcaataagttgcttagcagaaatcctagtgcctaayagagtacttgtaggcctgccaaaaccaaggtggctgaaagagtacctggaagatctgaagacacagctgggtaagtgcagtgggatagttcatggacaaa

SEQ ID NO: 3369 - DNA, 201 bp, Homo sapiens
taccatggaaaagtatcaaaataatatcattacctttgtgagtatcagaataatatatattactgtacaaagaaagtataagaatcaatatagaataaaastcatggagtttaaattttaaaataggtgcagttggaactcttttgttgagtttgtgagtgctgagcttctgtattttttatcttccgtttaagaggtttg

SEQ ID NO: 3370 - DNA, 201 bp, Homo sapiens
aacattaaaaataaaaagtgtatgaaatattgctagaaagcaaagatgcttttaaaatgtctgggggagtattgaaattaaggcatttccataagctaaaytgttaccaagtgagactgaaaaagagactaataatcatggccaataggcattaaaagaatgaaatcatatcctttgcagtaacagagatggagctggaga

SEQ ID NO: 3371 - DNA, 201 bp, Homo sapiens
attgtggtcagtgaacatactttgcatgatttgaattcttcaaagtttatggagacttgtattgaccctggatgtgaattattagtaaacgtttcatgtgytgttgaaaataacatgtattctattgttgggacagtagtgttttagatcaactatttcaagattgttggcagtgccatttaactttactgatttcctgcc

SEQ ID NO: 3372 - DNA, 201 bp, Homo sapiens
cttttttttagtttctgaatatttggagatatctttttgttactggcatcttaattctattgtggtcagtgaacatactttgcatgatttgaattcttcaragtttatggagacttgtattgaccctggatgtgaattattagtaaacgtttcatgtgttgttgaaaataacatgtattctattgttgggacagtagtgtt

SEQ ID NO: 3373 - DNA, 201 bp, Homo sapiens
ctttttatatcttcttgtgtcaattttggtaagttgtattttcctagaaaattgtccttttcttctaaatttaaacatttattggcataaagttgcccacyaaaatgtctcataaacctcttaattcctattactattgtccctttttaattcttgttatttgctttttgttagtctttatttcttgacccatcacaccag

SEQ ID NO: 3374 - DNA, 201 bp, Homo sapiens
ggctgtcagaggctgggggataggacaggtggagaatgagcgctattggtcaaaaagtacagtctcagacaggatgaataagttatgaagatctattatayggcatgataactattgttaatataatgtattgtatacttgaaaattgctaagagagtagacattaaatttcttaccactaaaaaagacaagtatgtgaag

SEQ ID NO: 3375 - DNA, 201 bp, Homo sapiens
gcaactctaagggactatgcagaaactaaaaaggcaggaaaaagtcattcgaacaacaaaagtcattcgagcaagaaaacatgacctttattccagagtaraatttagtatacattattaaaaggttgatatgcgagcaactgtgaaagaaactagtgattattaaagccagcatgtcctcattaaacaagttatgtcaca

SEQ ID NO: 3376 - DNA, 201 bp, Homo sapiens
attctacagagccacaggggtggagctgccaaaggccttaggagcccacgccttgcatagcatgccctagatgtgagacatggagtaaaaatagactattytggagctttcagatttaatgacagccctgttgggtttcagacttgcatggcacctgtagccaattggttttggccaatttctcccttttggaataggttt

SEQ ID NO: 3377 - DNA, 201 bp, Homo sapiens
gtttcataaaacacatacggggtgaaaaaacataacattcaatggtatagaatggttgctgtggttgggtaggggagaggggagcaggggaaggagtggtkcagaggaaaagtgagaataaacaagtaaagtggaatttgcttccatggacctttcacgtacgtattcctttcagatacaactttctgacctaaaatgcaa

SEQ ID NO: 3378 - DNA, 201 bp, Homo sapiens
atgtgttgctacgtcattcattacatgttgctatgtcattcacagaaacatcaggagtagacaagactgcctgttactgtgtagcactcgatccatttctsttttgatttggagatgataaattaaggaaactcttcttggtatgttcatttgtgaggatggtcagtgtaagaattagatgccagtgtatgtgtagatcct

SEQ ID NO: 3379 - DNA, 201 bp, Homo sapiens
ttcttaagcaacaagaattcctattggtcttttccttacacattaaattgaaccaaataatttcaaaagtctcaaaagctgtgaaattattataataattkgaaatgtgtcaaagtgtggagtatttatatgacaatttcatttaagctttcagggcactattgaaacacatttcaaccttaaatggccatccaggcagag

SEQ ID NO: 3380 - DNA, 201 bp, Homo sapiens
aaataacaggtattattttggtataattctagttaagtaaaactctggcagaactgttaagttatagagtaaaagacatttctacaggttggttaaacccytacttatagctcctatatattactcttgtgaatggctgctgataccaagcaaagattttaagggttattaatttaacttcttctgatgtactcaacaaca

SEQ ID NO: 3381 - DNA, 201 bp, Homo sapiens
agatatatagatgaatggaacaggaaagacagcccataaataaatccatgcatttacagccaattgatctttaacaaaggtgccaagaacacaaactgagraaagaacagtcttttcaataaatgagattgggaaaattggaaatccatgtgcagaagaatgaaattagacccttatctcacaccatacacaaaaaccaac

SEQ ID NO: 3382 - DNA, 201 bp, Homo sapiens
tctcaatgtctagctctgctctctacaaaccattattttcattcttttttatttaggtagtaatttgatataattaatacactcccacccaaggcacagawaaaataattataacaattcattctaacatgtgttctcctttaatattgtttcacaatgaaaatatggacctttggtaaaaacataatttctcctcttcgt

SEQ ID NO: 3383 - DNA, 201 bp, Homo sapiens
tagccttggaaaaaaaacactggttaaaataactaaaaacaaacacaagccaaaaaaaagggggacaaaaagggtaacactttctcacaaacttgttttgrgaatttctataaaaccattctgaccattagtcagcataacagtgtttttcagattttttggacccatatatatttactcaataaaatcatgactttattt

SEQ ID NO: 3384 - DNA, 201 bp, Homo sapiens
tgacaggtaaatttaaagcaaagtcaattataacaatatacacaatgtgcatcctcctgcagggatgataattggtcttcctaataagtccctggaaaaaycccaaatctgtagtctgtgggtggacatggtgactggtcttcctgccatagtgggcaaggaacgccaatcaaattcttggagtatagagacgttcaaggt

SEQ ID NO: 3385 - DNA, 201 bp, Homo sapiens
ataaacttaaataaaaagaactaaaaataaaactaccatacaatccagcagtcccactactgggtatatacccaaaagaaaaaaaagatcattctattagraagatgcctgcacttggatgtttatcatggcactattcacaataacaaagatacaaaatcaacctaaatgtctgtcaatggatgagttggtaaacaaaat

SEQ ID NO: 3386 - DNA, 201 bp, Homo sapiens
attctggactccaaattcggtattttttcaagagtatccaaagagacaaggtccattctttgatgcaggaccaaggtagcactaatccttggctagttttyggaaggcaatctcaaagctggatgtgatacaaacagaataggtattgggataactccagaaaaatttagtctttcattaattcttgcatgcatgcatgca

SEQ ID NO: 3387 - DNA, 201 bp, Homo sapiens
aaaaatgtttggagagcagtaagtttaataaaacaaaagcatttcatttaaaaagaatacagcatttttgtttcttaagaatacaaatactgtatgttttratgtaaaatgtttatggacatttgccatccaccaagggcacaggagtaataacaccaacaatgtgaaaaccagaaaacaccaatcagcttaagaagctta

SEQ ID NO: 3388 - DNA, 201 bp, Homo sapiens
aaggtgtgttgaacccaatagttttaaaggtgatctagtaaacagcatctctcagtgggtcatttctgcactgcttggaaagtcatatgtagagactcatyttagatcccattcctccagcttttccaatcattttaagcacctaattacaccctatttccgcttaacacctaaaatagtttctatttcatgcacagagac

SEQ ID NO: 3389 - DNA, 201 bp, Homo sapiens
aatgaaatcaatttctttgacaataaattaggaactatctgtttcatggcccacttttccctccaggtgaaatctgtaaaccaggactctagagctggaaragggaaaaatagcaagcttttctccaagtgtctacctttccctaggaagtgagtgcttctggagtggggttagggggcagccagaggtcctttcctttac

SEQ ID NO: 3390 - DNA, 201 bp, Homo sapiens
ttatggtgtatatagtaatgttgcgatacacatattacatagtgatgagatcagggtaatttgcatatctttttcttttatctagttgtctatagctgttmtcactggcaaactagctagcctacattttagctagtatcttgaatctcttcctaatatgcttttactacaacctgcactgtttctgagagtgcccttaag

SEQ ID NO: 3391 - DNA, 201 bp, Homo sapiens
gagaggcagggctagatcatgtagggcctggtagatcatgataaacagtttcaacttcatgcaatgcctatgtaaaagtataaaggcttttttttggttgkttgtttgttttaataggaaggtcatcaagatcctattgcagcaattcagaagggaagcaatgatagtgatttggactagtgaaccattagtggaaaatgg

SEQ ID NO: 3392 - DNA, 201 bp, Homo sapiens
tctatggtctgaaagcaaagtcagctaataagtgatgcaggctggtaacttctacagtgtggatacactggacaaagaaatgattcatgtcctgggctggrtgaatcaggatgtgtgagatttcatcatgctactcagaacggtgtgtaatttaaaacttaacaattggtatttctggaattttctacttcatattttcta

SEQ ID NO: 3393 - DNA, 201 bp, Homo sapiens
aagtgcatacattttgataaattttgaccctacagttaagacagtgaacacatacatcattcctagaagtttctttgcatcctttgtaatccttcccttcygactctccctaccactggatgggtatagatagatttgtaaattaatgttttttgtctttcattattttaaagatgttgctccactatctgcaggttcttg

SEQ ID NO: 3394 - DNA, 201 bp, Homo sapiens
ttaatagcattattgaaatataattgacatacagtaaagtgcatatatttaagtgcatacattttgataaattttgaccctacagttaagacagtgaacayatacatcattcctagaagtttctttgcatcctttgtaatccttcccttccgactctccctaccactggatgggtatagatagatttgtaaattaatgttt

SEQ ID NO: 3395 - DNA, 201 bp, Homo sapiens
catcctgcacatgtacccctgaacttaaaagttagaaaaaaaaaaaaaactcttaaacttttaacattgtggttgtgtcattgaagatgtgtctgcattcyagcccctgatggcaaggctgccctaagtgacacaggcacatggaagccctgctggtgctctttggtcctggcctgtggtggctgctgagggcaatagcta

SEQ ID NO: 3396 - DNA, 201 bp, Homo sapiens
caggcttttgtctacacgggcctgcaactgattgaatggggcttgcccacattgtaggggatactctactcaaagttcaccagtttaaaggtagatctcaytgaaaacacctgcacagaaacaatcataatgtacaaccacatatctgggcactgtggcacagctgtgttgacacataaaattaaccatcacacttagtct

SEQ ID NO: 3397 - DNA, 201 bp, Homo sapiens
aggtgagaaaacctaggcccagagggtttaagccacttgactgaggtcacacagttaaaggcaattagcattcaaaccccaggctctctagaggtggcccwtgtccttggacactaagttctatgccctcctggctcaccctgcccttcccgatgtcactctgcccttggttgggttttctgtgtgatgactcataatatt

SEQ ID NO: 3398 - DNA, 201 bp, Homo sapiens
aaaggactgaatttctatccgggtgggaaagaaagataaagctctgtcaactgaggcatcttatggtggacctaccactgctacttccacgtcatctataycagccctgggtactcttgaccacttcacctgtgtagatcctcatcttggcctcattggttgttctgtcccagggaagaaatgttgacttaaaaaataggc

SEQ ID NO: 3399 - DNA, 201 bp, Homo sapiens
gtggtgtgactgaagaactaaatggtcaatcttatttagtttcaattagtattcatttaaatttaaatggctaaggtgactagatgctaccatatgagacrgcacagctcttacaggttacattgcccagggtcttaacttagcatgtgacagaattagggccataatgagagaggggtttggagttgggcagttctggcc

SEQ ID NO: 3400 - DNA, 201 bp, Homo sapiens
ggcaatatacagtttttttgagctgagcatctagaactttctctgtatgaaaaattcaatctgtacaaaatttggggcaggtgatccatgggaaaacatayatctcttgaatgacaaaagggtgttgaatttagggggcagcttagagcacatccactcatctagcatgctgagtgccaggcaccattgccaggcactggg

SEQ ID NO: 3401 - DNA, 201 bp, Homo sapiens
gacatacagaggcctcatggtgggatagaacgcggagactattggcttctttgctgggaatgcctttcttcctacatccctctctttttcctttccatctrgttaactcctgttcatctcttggttcttagagcagttgtccctgtagatattttctaccttgttttttatttttttatacatcataaacataattttttt

SEQ ID NO: 3402 - DNA, 201 bp, Homo sapiens
tgtacctttcttcctgtgtggttttgggtaagttacctaacctctctgagccttagtgttgtatctttcacctgggactagtgttcaccaagggctattgytgcgataatcaaaggaaggagtgtggatgaagcccctgagcgctgtgcctgggaatacttggtgaatggagctattgttactgggtgtatagagttcctg

SEQ ID NO: 3403 - DNA, 201 bp, Homo sapiens
tctctgagccttagtgttgtatctttcacctgggactagtgttcaccaagggctattgttgcgataatcaaaggaaggagtgtggatgaagcccctgagcrctgtgcctgggaatacttggtgaatggagctattgttactgggtgtatagagttcctgtgactatgacttagtcacctgggtgcagggagcctctcggtt

SEQ ID NO: 3404 - DNA, 201 bp, Homo sapiens
gggttctcaaacttaaaatggtaaagtatatgcgaggcttctagagacctcagttctgaccagagcagaacaaattaaacctgatggattcctttcgctgyctgtgtagtgtggggcaatgcagaacaaagtgctgtggcgttgcggaaggggttccctctggcagttttggaatttggtggtaggaaatgttagttattt

SEQ ID NO: 3405 - DNA, 201 bp, Homo sapiens
aaatacttattttataatatttaactcagtttggaatgttacatgacagtttacttctgcttcatggttgattttctttgtgggggagaattttaattagytgaaatgttttggtgcatattttatctttaaaaaaaaaaatcagctccactgattagccgaggaatactaataacaatgtggagttagtacgagttttcc

SEQ ID NO: 3406 - DNA, 201 bp, Homo sapiens
gcctgctcctgtgttcgaaggtctcatccccctgcagcagccccctgcagtcttatgggtgacgcagagggaagggtgggtgctgtggagggagccctccracgtggcccctctgcagcaatttggggacagatgggcgtgtgctgctcagtgtgtctctggtacccctgtcctacaacatgggtgagggggaagaaaagc

SEQ ID NO: 3407 - DNA, 201 bp, Homo sapiens
ggtcgcacagctgctaggtggtgaagctggaatcccagtccaggtctgtgctgtccaaagccattgccttcacctctagctctaccatggtgctacctggygggatgaggtgctcagtgaaggctggctgcagttcctttgcctctctagaccaacaacaggcttgggccttgatccaagattacagttgacaccaaatgg

SEQ ID NO: 3408 - DNA, 201 bp, Homo sapiens
ctcagcttcctcgagcgacagggctaccccagactaaggacaatctgactctgaacttttgggcaatcttttccatgggctaatttgctataggattgctygtttttcctggaagaccgagtggctcttaggagtggatttttttgtccacacttagaagaccagcaaatggtctttccctcttctgtactctgaatcaga

SEQ ID NO: 3409 - DNA, 201 bp, Homo sapiens
cccagtaacgggattgctggatggaatggtagctctgttttaagttctttgagaaatcaccaaactactttccacagtggctgaagtaattgacattctgrtcaacagtgtgtaagtgttcccctttctctgcagcagtgccaacatctgttgttttttgactttttagtaatagccattctcactggtgtgagatggtac

SEQ ID NO: 3410 - DNA, 201 bp, Homo sapiens
ggacccaagctaggccaataggactcaaacccagagtttttgatggcttggttgtaaagctaggactttttaatcttggagctgctggcagccctcttccrtcattgcagggaagaagcctatgtacaatagggaaaaatgaggccaacacatagaacacagacagtgtaaatcaacctctaaaagcacaatctgtcaggt

SEQ ID NO: 3411 - DNA, 201 bp, Homo sapiens; identical to SEQ ID NO: 1364

SEQ ID NO: 3412 - DNA, 201 bp, Homo sapiens; identical to SEQ ID NO: 1365

SEQ ID NO: 3413 - DNA, 201 bp, Homo sapiens; identical to SEQ ID NO: 1366

SEQ ID NO: 3414 - DNA, 201 bp, Homo sapiens; identical to SEQ ID NO: 1367

SEQ ID NO: 3415 - DNA, 201 bp, Homo sapiens
tttgatcaaggttgaactgaaattcttaacacctgatgatgagactgtactaatacctgaaggcatataagattgcctaagaaatcttttgccatagggarggagaacccagagaatgtaggtgaaggtagtgcttagaaaataatgaagctacagagacagaaactagacaagtgattgcctggagccagagtgtaggag

SEQ ID NO: 3416 - DNA, 201 bp, Homo sapiens
tatggtattttgttatacagaccaaatagactaagacaaggaaagtgacttgagaattagaatccatcttcctgacccaaagcctagtccaaggtgttgcwactgagaggtgacagcgtgctggcagccctcgcagccctcgctcgctctccacgcctccactgcctgggtgcccactctggctacacttgaggagccctt

SEQ ID NO: 3417 - DNA, 201 bp, Homo sapiens
aaagattgccttgtcatgaaagaaaccactggcaatcaaataaaccagcatcaggcaaataatacttgccctttcttggtaaatttagcacacatacttgmtatacgcatatacatgctctctctcacatgctctttctcattctctctctctctttctgtctctctctctcacacacatgctcaatgttttactctaaag

SEQ ID NO: 3418 - DNA, 201 bp, Homo sapiens
gatgaggagatgtgctgtggcatcgcaaatgctaggacataaatgttctgaaccctaaaccttgcagtttagcatttattgtaccaagtacaataccgagyttatctatgtatacagttttagaaaaggagcaattctatgtacttggagattaaagattggtttacaatttgtattaaaacaaagagctgctggtcccaa

SEQ ID NO: 3419 - DNA, 201 bp, Homo sapiens
tgaaggacatgctaaaaggtaactcaaccagtctagtagtaactcttagctcatcaaaaaccttcaaccacaataaaagaagcccagagattctataaggragacagaaaatactttgaagggtatttatagggatagagtgacatttatcccctctctctcctcaagccacctgaaaggttggcaagagaattccttagg

SEQ ID NO: 3420 - DNA, 201 bp, Homo sapiens; identical to SEQ ID NO: 1391

SEQ ID NO: 3421 - DNA, 201 bp, Homo sapiens; identical to SEQ ID NO: 1392

SEQ ID NO: 3422 - DNA, 201 bp, Homo sapiens; identical to SEQ ID NO: 1393

SEQ ID NO: 3423 - DNA, 201 bp, Homo sapiens; identical to SEQ ID NO: 1394

SEQ ID NO: 3424 - DNA, 201 bp, Homo sapiens; identical to SEQ ID NO: 1395

SEQ ID NO: 3425 - DNA, 201 bp, Homo sapiens; identical to SEQ ID NO: 1396

SEQ ID NO: 3426 - DNA, 201 bp, Homo sapiens; identical to SEQ ID NO: 1397

SEQ ID NO: 3427 - DNA, 201 bp, Homo sapiens; identical to SEQ ID NO: 1398

SEQ ID NO: 3428 - DNA, 201 bp, Homo sapiens; identical to SEQ ID NO: 1399

SEQ ID NO: 3429 - DNA, 201 bp, Homo sapiens
tgttttttaattgactccaggaaagaaaaaataagcagcccaaatctgtcacttcacctaattttgtttcccaacccaagccaagccatttcctacacatstggattcagatatcatacgagaaaacacgttcctcgacacccatataaaactgcagtccccggccctcattctttcctggctttatttttagcactttct

SEQ ID NO: 3430 - DNA, 201 bp, Homo sapiens
ctgcactccagcatgagcaacagagtaagaccctgtctcaaaataaaacaaaacctaaaaccaaaaaacagaaggcagagaagagtggccactgtaaaagrttgtttatttccagggataatattaaaaaatgcataacaagcaggacattgaccaatctgaccaccagtgggaggtaaataattggtaaggggcttattg

SEQ ID NO: 3431 - DNA, 201 bp, Homo sapiens
gcctcccaaagtgctaggattacaggcgtgaaccaccgcgcccagccagtctctctccacttcttacaataacaccagtcccattggattaggagtctacyctgctccaggatggacccagctagttacgtctgcaatgaccctgcttccaaatgaggtcacgttctgaggtacagagcattaggacttcaacgcatcttt

SEQ ID NO: 3432 - DNA, 201 bp, Homo sapiens
tgcagaaccgttagccaaataataccttttctttataagttacccagcctcaggtgtttctttatagcaactcaaaatggactaatacagggggatgctartcaacccatcacaggaataaataggatgattacaggacctgaggaggagggttttggctggggaggagagggcagtgagattttgaagaccagttagcat

SEQ ID NO: 3433 - DNA, 201 bp, Homo sapiens
agtcatttctgccatcagaaaacatacaggctcaagacaaacactcaattcaggacaaaacaaagaatgccccatatttggtactcctgagttaagagcaygagaaatttgaatttgctacagaattgtatatcatctagcttattaaaaaacactgggctttacatctatctgaatgaaacagtaaaaggaagatgctat

SEQ ID NO: 3434 - DNA, 201 bp, Homo sapiens
gaatccagatgctcaggcccaacccccattcaattaggtcaggatctctgggggtgggaaccaggaaatgctttctgaaatctcccccggggcattataayatatagccagggctgagaatcactgctttagagtactgattctcaaggtgtggactcggaactagctgcatcagcatcacctggcaacttgttagaaatg

SEQ ID NO: 3435 - DNA, 201 bp, Homo sapiens
gaaatagacattaactgtaaactaaggaaatctgaataaagtatggactttagttaatatgaatgcaccaatatcggttcatggagtgtagcaaatggacyacagtggtatgttaataacagggaactgggaaaggaatatgtgcaagctctagctccccaattttgctgtaaatctaaaatccttttaagatgaaagagt

SEQ ID NO: 3436 - DNA, 201 bp, Homo sapiens
accacttgagaggtaccaagtcctgtagagattcagaggaggaaaagtgcacttctggctgtgggtcaggaaaaggctccaggaaagagctggctcggagrgataaggaggcttttagtggatggggaaagaaaagcattcaaagatgaaacagcgagagcaaagtacagagggaacgcagaggtgttgtcaaagactgat

SEQ ID NO: 3437 - DNA, 201 bp, Homo sapiens
acaaagggtattttctcctctttctttatttacttgttttaattggtatttatatttacctatgtgaaaccgtattgctctgaccttgtcacatggcatgsattcatatctggaatgaggttaagtcttctggagctgtgctacatttttattcttaacctgaggaatatgagaattccgacacccattggtgataagcct

SEQ ID NO: 3438 - DNA, 201 bp, Homo sapiens
gatgaatccatgttttcttgctttgtaaatcatcatagtgccccgaacaatgttctaaacacagttattatttacatcatataggtagaataaagatgaarcaaggggagagtcaccccgcagacattatcagagacttaatgagttcttgggtgagagagtaagaatgtgagtactctgtgagtgtgtcagagctggagg

SEQ ID NO: 3439 - DNA, 201 bp, Homo sapiens
gctcaaggtgttctcctaagattatgacttatactccttggaaatttgtgtaattgatgcctttggaaaatatgtccaagactcacctttcactctgttcyggaatgaaggctgaatccagagaagctcaccctgctcccttctccaacgtgacacagaataaagagggtcagagtacaggtcttttattgttttaacctg

SEQ ID NO: 3440 - DNA, 201 bp, Homo sapiens
gtactttttacatttatacaaattaaaaaaaagatttcaaatgatttttaaatgaattacatatataccctaacttgtttattttctttttccttccaatstttgaaaaaatgtttttgtataatacaaacacatttccaacattaaatatccttaaaactttaaagttgaagacaaaaatataataacgataagcaaaga

SEQ ID NO: 3441 - DNA, 201 bp, Homo sapiens
gtttatattttgaaggtttgtaaaatttacattttgatctatattatggtttccttccatgttttatctataggctggtttaaaaaattcaaactaatgarcagtatatgatcatgtgatcacagtgacatattgtatcccccaaaatggctacagcagtattttcagtcccacatgagcttccaaagccttgccactctc

SEQ ID NO: 3442 - DNA, 201 bp, Homo sapiens
attagatgtgtttccttttcctttttttttttttttttttggtacagttgtaattatgttagtcatctcttggatgtgttttagatagaactttgttaaaracatctgggcctaataatttcaggcagaagtttaaagaaaaagtagatattaacccactgattcaatttctttattggttgtaagtcttttcagatttcc

SEQ ID NO: 3443 - DNA, 201 bp, Homo sapiens
actccattctccccaactagaggcacagaccatgacccacatctggtcacccatcctatgttagtcctttggcctcagccattggtcaagcatgggcatgygactctagccagtgtagggagaacaagccccaggactattgctaagacttcaaagaaggagatgttttctttctgttcaggtggctcgactggaaggaca

SEQ ID NO: 3444 - DNA, 201 bp, Homo sapiens
ccctgtgacttggatatgacacttagcctctctgtgtctcagtttcttaagctgtaaaatgggaagaataatagtgacaacctgatgggattgttgtgatrattaaatgtgcaaatgccgtgaagcattagtagagtgccaacctagcatatactgtgtgccaatgatgcagtgtctttgggaggatgttctgcttctcat

SEQ ID NO: 3445 - DNA, 201 bp, Homo sapiens
acgcttcgtacttggcctgtgttatttatttttcataacagtcctggatattggaactcactatcctgaacaaattaggctgagagagccagagcagcttrcccaatatcatgtggctggtaagtggcacagatgagcagagctttctcctatgcttcatgagctctcgtaggaatgtacttcttgggcttcctcgcctca

SEQ ID NO: 3446 - DNA, 201 bp, Homo sapiens
ctaaacgcatctatcaactgattgaataaatgtaatgttagaggcaatggaactctgtgcctccactttttagagctggacaactgacatgcacaaagatkcctatgttaagagacttagctcactaccgcaacattttgactttagtttgaactgttttctacattttcaatgatcactttgagattcaacattaaacca

SEQ ID NO: 3447 - DNA, 201 bp, Homo sapiens
gaggaaactgacagtttttgtttgtttgttttttgttttgtttttttgagacagggtctcgctctgtttcccagtctggagtgcagtagcaagatctctgwttactgcagccttgatcacccagactcaaaccatccacccacttcagcctcccaagtagctgggactacaggcctgtgccactatgcccagctaattttt

SEQ ID NO: 3448 - DNA, 201 bp, Homo sapiens
tgtctcttccctcctctctctgccatggctaacaatagtcccacccttcactttctccgttagaaaataaataatcaaagcaacggaggagattcagactrtctgaaaataccaaggacatctttgaagtggctgagtacacagccttttgagagagacagagatggcttcaaatacaggctctaccacttactggctcca

SEQ ID NO: 3449 - DNA, 201 bp, Homo sapiens
gagggatttgaggtacatctgtccaggtttgaatcctagtttgagcagtggacaaacctctgtactttagttcccccagctacaaagtattaatagaattkcacatgagaacttacttcatagggttggaatgagagtgaaacaagtgaatacatgaaaggcctttagagcagtggattcttaactttggtgctcacagaa

SEQ ID NO: 3450 - DNA, 201 bp, Homo sapiens
catacatgaatggactgtgatatacaaaacagtcatgagtgatgtaggacaattctttattgtgtcagactgctcaaacactgcaggacattagcatcccyggatctcacccactaaattccaacagcacatccaactattgggacaaccaaaattgtccctgtaaatttccaaagcacactcagggactagacctctctc

SEQ ID NO: 3451 - DNA, 201 bp, Homo sapiens
tgttcacttctgcaaataatctaagaagatgattacagtgctaccaccaaggaagatggaagacctacccctatggacaagctgttcagagcttgggtaaytgaactactgaataataaatataatagctaacatttgtatttgtccagacaatgtaaaaagcacactctctctaaaaggtaagttattattagcttcaat

SEQ ID NO: 3452 - DNA, 201 bp, Homo sapiens
tggatttaaatattcatgaactgacacaacttgattatgacaccttctttacaattgtgatacagagttatctacacatacttaaaggatggatgaattaytcatgtctgggcagccccactgttgagtgtctggctgcttgatagatatgagtactccagccagttggcccaatacataaacagcatttaaagtcaacag

SEQ ID NO: 3453 - DNA, 201 bp, Homo sapiens
tggagccataatcagggggtccattccatgggagtagagctgcactcttactcttattttcccttctacatgggcttgaatagtactgagtcttctacctrcctcagcttcttcccctactctttcccactttcttttttctccttcctacagacacacatgaccattgctcagctacagtgagacaatctggagagaagt

SEQ ID NO: 3454 - DNA, 201 bp, Homo sapiens
ccaaatttatttgcataatatgagagcaagagagaagtaatcctaactgaagtagggatataatgctaatcaccccatatatttgcatacatgaatggacwgtgatatacaaaacagtcatgagtgatgtaggacaattctttattgtgtcagactgctcaaacactgcaggacattagcatccccggatctcacccacta

SEQ ID NO: 3455 - DNA, 201 bp, Homo sapiens
agaagatacaagtgtgatttgcattttgttctgaacaaaatcttaagtagtcacatttcatacatcaaagagagtaaactcacagtaagaaccattgcatrtgttatctactcttatgtgaaaatgtatggggaggtgctggacttctatttgtcattgattaacaataacagcaaatatttgtggagcatttataatgtg

SEQ ID NO: 3456 - DNA, 201 bp, Homo sapiens
atcctacctatttttccaactcccaaaagtattagaagccacaagcacagctcgctccatttctcttctctttttatgcctccccttttccttgtaaccaktattatccatgggagaggttccacatgggattttccaagaggccaggccagcttgacacacagggcccttccttactcagcccaaccgcaaccctcttcc

SEQ ID NO: 3457 - DNA, 201 bp, Homo sapiens
tccgagttggatgaggatttttgcttatttcagcaggatcattttcattagacttctccccactagggcccttctagggtcttgagaactaagctcttgaytggaatcttgataacaactggttactactatgtgactttagaaagctgacccagcctctgtggtctccatctcatgattttcaaaataaagtatctgaat

SEQ ID NO: 3458 - DNA, 201 bp, Homo sapiens
aacattcttctcaatgtagtatgacaactggcaatatctggcatctctatcaaataatttctgagttccttttaaatgagcatgttaaaatactaaatgcycatgttctggtttcttgtatattttagaatttgtgacctctggtcacaaattcaggtgactgaaattagatgattttctccatataactttagatcttag

SEQ ID NO: 3459 - DNA, 201 bp, Homo sapiens
acccaatacacctatgaaaattgagacactggcctgaggacacatgagatgctacagaagctaggaaagggtttatatcagagttgcttagaccattggtyctcaaagtatggtatctgggaacttgttagacatacaaattactgggcctgacagaagaactttgggggtgaggttctacaagccatatcttaacaagcc

SEQ ID NO: 3460 - DNA, 201 bp, Homo sapiens
tgtgacagacaggctttgaggggtcctccatcatcccttccttcttgttgttcatgcccttgtataaacttcacttgaggagtctgtgggcaggactcatratgtacttctaatctacaggatatgacaaatgggatgaaatgtcactcccatgactatgttgtcttactagcagatgactctttcttggtagcagatttg

SEQ ID NO: 3461 - DNA, 201 bp, Homo sapiens
ttagatttagaaagatggagtggggtggagtggagtagagagattggaaggctgaaaaagatggcaaaggaataatgaaagcaaaaggccaacacttatcrataggtctgttgagtgcttgtgaatgttgattttaaaaaataataaaagactccttactggatgcttctggcattgactattccaaaggcccaggactca

SEQ ID NO: 3462 - DNA, 201 bp, Homo sapiens
aatttgtaaaaacagaagcattgtctccaaaggaacacacactaaagtgtacattatgctacctatgagggaaagatgaatccattgtttgtatataaacrtgagctgattttcaggatgatccatggtgtctcatgcgtgggagcttgggagttgggtagaatccttgtctgagggttggaggctctcttgaaggaggca

SEQ ID NO: 3463 - DNA, 201 bp, Homo sapiens
tttatttctgtattggcattaagttttcacaaacgacagccatttaatgtaaaactgacattctggcatcaatcacatgcccagaagagtcagataatcamcaacagtttataataacaccacaccagaataattaataaagtatgaagttcaatgaaaagaagtgtgtgctccccaataacacaatgagaagatattcaa

SEQ ID NO: 3464 - DNA, 201 bp, Homo sapiens
aaagtcatcctgaaaatcagcatccagtagcaaaagggagaagagagagtggagaatcctttgggcagttttcttgatcctggcctagtagtagtgaatckcccacattccattgctcagaactcagccaaacaactccacctagatgcaagggatgactggaaaagataatcccaggatgggcagtgcaatccagcaaca

SEQ ID NO: 3465 - DNA, 201 bp, Homo sapiens
ccactaggacccttcttgagtcttgagtactgagctcttgattggaaccttgataacaactcgctactgctatgtgactttagaaagctctgcttctgtartatccatcttattattttaaaaataaagtgcctgaatctgatcagaatctgagttgcttgttagtctaggctaaggctggcggattagtcatacatgaca

SEQ ID NO: 3466 - DNA, 201 bp, Homo sapiens
gtattcagctaaaaagatgaataaaatggtaccaagtcttccattgctccaagtgtgaaaatccaaaaacccatccaaatatgccaggacaattttttacratgggaatagtgccaaaaatgtataaaatattgagaaaatatttcattgtatattcttctacacgacaatttagccagaaagaagacccaaaatgataaa

SEQ ID NO: 3467 - DNA, 201 bp, Homo sapiens
tttaaaatgactaagaaaacaagaaaatgagctcagtacacagtagtttttaaaatgcaagttaaaagcggaattagatactgctattcatctaccagaaygagtaaaagaactaacgatatcagatattggcaggaatttgaaggaactggtattcttttctattgctggtggatttataaaatgatacaccaactttgc

SEQ ID NO: 3468 - DNA, 201 bp, Homo sapiens
taaaaaatggctaaagatgatgtcatgtgtatgtcattggtgaacttgacaagaaaagcttcaggagagagagagaaaaaaaaagcctgactgtagaagayacaagagaaaatatatgagcaatctagtctccagcaactcgcaacagaacggtgaccttttcaacactataaaacacactacattttatagatgtagagt

SEQ ID NO: 3469 - DNA, 201 bp, Homo sapiens
aatgggcacatatgaacaagtacacctacacctgtacatttaaaaacatgtaattatacccctacgttgttctcagaaggattcaagatatttgtgcacakgagaaataaaacttaaattagttttgccatttagaatttctctccctaaaataaagttcatgaatatgtattttatatttgcataaaaaaggcaaacacc

SEQ ID NO: 3470 - DNA, 201 bp, Homo sapiens
ttggcctcccacagtggtctttttttaataaggtgaaaaaaaaatttttgccaaggtcatgtgccatgcttttctatccactgcccaggaaatcaaaaggyactccctccatgagcttcccgcagtgaggactcatctgtaacctcataatgttaccacctctaaggcaaagcggaaaatgtctgttctccaggttctcct

SEQ ID NO: 3471 - DNA, 201 bp, Homo sapiens
tcagaatcaccccggcttacccattaaaaatatagttccttggtttcatccagacccacagaatcaagtttttccaaggtggagctgagacgttatgtgayggttaattttgtgtgtccactgggccacaaggtgcccagatatttggttaaacgtgattctgggtgtgtctgtgagggtgtttctggatgcaattaacac

SEQ ID NO: 3472 - DNA, 201 bp, Homo sapiens
agtcacatcaggggctgcgtccgctttgctgtactggtgcgattccagtttctgcctgctggcctcggcgtccccccaggcctccctgaccagggaatggrtccagttccaggtctcagcctcttattggcagcttcactcctctgtgattcaatagactggccccaggatctggcagaatttatgctgcccaccagcttc

SEQ ID NO: 3473 - DNA, 201 bp, Homo sapiens
gagatcacattgaattccttacctttttctctcagcaccatgcctttaagctatgtttgtagcaacgtgagtatctaaattttgctcctcactgttgaatytcaccgtgtgcttttaccacattctggtctccgggtaaagaagcccagatggctttcaacttcctaacaccacaaacagtatcagaatgaacattcccag

SEQ ID NO: 3474 - DNA, 201 bp, Homo sapiens
gcaagggagaaagaaaagtgatcagtgaggtgggaggaaaccaagagtacagtgacccaaaaaataaagaagaaaaaagtgtggggagaagtagtcaactrgttcaaatgcagctgagagaataagtaaaatgagaactttaaaaaatggctaaagatgatgtcatgtgtatgtcattggtgaacttgacaagaaaagctt

SEQ ID NO: 3475 - DNA, 201 bp, Homo sapiens
ctttaccttcaatgtatacccagaatccagccacttctcaccatccacaccactctcatcatctcttgcctgaattactatagcagcctcctgtcttgtckcccacttttcagttattgtgcctatccacccactatctacacagtggctcacccacataaacagttgctccttgactactcttcagatctaggcataaac

SEQ ID NO: 3476 - DNA, 201 bp, Homo sapiens
atgttaaatgagggccatggaaggaattttttcctcttcatgagagagatacctttgttctttggcacttccatggcaactggcccaagagcctcaaagaygttctagttaagtgacttaattagctaaaatgcttaatggtggagagatgtctactgggattggaaggactccaagtgggattccagacaattccaatgg

SEQ ID NO: 3477 - DNA, 201 bp, Homo sapiens
ttagtaatgtatctattttattgtagggattcagaatttctaattgttacttatattctacatgcatgtcctctaacttgtgtgataaatgacagattctratcagcatcctttctacgggtctgaagaggaactacaaggtgttaaagacaagaatgtcactccagcttgcagcactggtgcctcagcccttatcaatct

SEQ ID NO: 3478 - DNA, 201 bp, Homo sapiens
gtttgcctagcaaactaataacacaaataagacttcagaaagatatatgtggtctgcttatctaaaaaacgtaaataaaatcctttgaaatgtatttatgmaaacaaccttcttagatatgtattttctgttcattactcttaatatggaaacatctcaatacaagtttcagtgtatgtcaatttttttaagtatttttaa

SEQ ID NO: 3479 - DNA, 201 bp, Homo sapiens
ttgaattccttcatggtgtaaaacttcttaccatttattactgttttatttatttgtctgttagctgagattttatttatctctctcacaagaatgcaaakcccattgcagtattctaagtgtttgtaatgtgtggttggtgcccaacaaagacttttacataaatgaatgagtagcaagttacatagcaaaggaagagga

SEQ ID NO: 3480 - DNA, 201 bp, Homo sapiens
ttaacaatctgattattcaacacttttcccaggacaggatcttacccagctttgggggccacatggtcgatctgctgatttgctgaaagtcttcagagatrtccttccaccacttgacaaatcctcctcctcctcctcctcctcctctttctcgacacgctgcctttggatttcttccccaccttggctagtgtacaatct

SEQ ID NO: 3481 - DNA, 201 bp, Homo sapiens
agagactgcagaggcttaatgcccgcaaaacaggagcaggtgtgctagatttctttactctgaggtaccctcggccccttccagcatctattaacaccatkggctacaaggtacccacgcttgccagccaccctggctggatgcatgtggctatgtgtgtgtgtgcatgagccaggagcaccaccatgcacgcacccttat

SEQ ID NO: 3482 - DNA, 201 bp, Homo sapiens
tatgtgtgtgtgtgcatgagccaggagcaccaccatgcacgcacccttatttctggcctgctggcctcaggaaaatcctttctcccagccttgggctatgwtgaccagcctgcatgacaacttcatcttctttaccttcccaggctgtccacagttctggattctggtaaacccttcactatgttatttggtaatctcaga

SEQ ID NO: 3483 - DNA, 201 bp, Homo sapiens
aagatcaaggtgttggcatctggtgtgggccttcttgctgcatcctcacatggcagaagggcaagaaaggaatgaacgttgtgtcctcacagaggaacagragagaaagaacccattcccacaagccgtttttataacagcattaatccatagatgaaggcagagctctcatgaccaactaccttccaaaaggccccacct

SEQ ID NO: 3484 - DNA, 201 bp, Homo sapiens
ctgtcccctgcccagcatggaaaaattttgagtcccttcaagggaaattccaggcacccaactagccctacggccagcaattagagaattgaataaataaycccctaagtgagaagatcataataacttttgcaatagccacccaaataagtcagagtcacaagatgtttgtttccctacagaaactaaagataacatctt

SEQ ID NO: 3485 - DNA, 201 bp, Homo sapiens
ccaggaaatcaaaaggtactccctccatgagcttcccgcagtgaggactcatctgtaacctcataatgttaccacctctaaggcaaagcggaaaatgtctrttctccaggttctccttgtctttttacccttttagaatcagtaaacaaatgattgaaagctaagtttccgaatcttaacagaaataaaagttcttccaat

SEQ ID NO: 3486 - DNA, 201 bp, Homo sapiens
ttctatccactgcccaggaaatcaaaaggtactccctccatgagcttcccgcagtgaggactcatctgtaacctcataatgttaccacctctaaggcaaakcggaaaatgtctgttctccaggttctccttgtctttttacccttttagaatcagtaaacaaatgattgaaagctaagtttccgaatcttaacagaaataa

SEQ ID NO: 3487 - DNA, 201 bp, Homo sapiens
aattgttttgggtattctgggtacagatctattctagatcctttgcatttccctacaaattttagaattagctgtcaatttctgcagaactccctcagggrttttgattggaaatgtgttgagtgtatagatcaatttgtggagaagtggcattgtgataacattgagtctttccgtctctaagcatagtataggtctctg

SEQ ID NO: 3488 - DNA, 201 bp, Homo sapiens
ttgtgtgtccactgggccacaaggtgcccagatatttggttaaacgtgattctgggtgtgtctgtgagggtgtttctggatgcaattaacactggaattgrtaaactgggtaaagcagattgacctccccagtgtgggtgggcctcatccaatctgtcaatacgctctgtaatcttatcaagtgcttggaatctgcggaca

SEQ ID NO: 3489 - DNA, 201 bp, Homo sapiens
aaaaccaccaccaaacagggaatcagggaaggctgcatggaagaaacggcacctgcccggggccttggctcctaactcctggtacctgaaagttgtcttcytcagtgttcagttgcatgcagctagcgctggttaagtagttaattaagaaggtgtcttgagaacttggttaccacctgttccctggtttgctgagggaaa

SEQ ID NO: 3490 - DNA, 201 bp, Homo sapiens
actcctggtacctgaaagttgtcttcttcagtgttcagttgcatgcagctagcgctggttaagtagttaattaagaaggtgtcttgagaacttggttaccrcctgttccctggtttgctgagggaaagttgcggcttctgctaagttttaaacatagcggaaaccacttacaaattaatgatggaattaggctggggtgca

SEQ ID NO: 3491 - DNA, 201 bp, Homo sapiens
atatatttgtgtttggcctgttttttcacatgtgagttatatttcacaataaaaaatgactttttaaagagaaaatgaatagggaggaactaaagtccatkcatatgtccatattctcaatttgggaaaaaatgtggctttgtcttcatcctcttttcctgagtgtataaggccagaagccaaaggcaagagcaggacatt

SEQ ID NO: 3492 - DNA, 201 bp, Homo sapiens
cttctgtatacaaaggtacaaattctagtaaaggctgcaacattattccattggtgctgattctactaaaagcacttggatgatagttattctggcattawttttgcatgcaacaaggcaatgcaattgaatataagtatcgggggaagtgtttgtagatgattttctagagctggttcaaaggaaggggtgtgttatttg

SEQ ID NO: 3493 - DNA, 201 bp, Homo sapiens
cttaggagatgaacccagaaggttaaggccagtatttaacattttcgaatttaaagctagcttagcatcttgctactttatgttcagaagagtttataaayagtgattgtatctgattacataaactatttaagttaaatttagcctaacaattattttgcttcctctagcaactgaatttggtcaatccaacagtttatg

SEQ ID NO: 3494 - DNA, 201 bp, Homo sapiens
gatcacatgaacccaggagtctggaaatgcagtgcactctgattgtgcctgtgagtagccactgcactccagcctaggcaacactgtgggactccatctcrgagggagagagggagggaaagagagagggaaggagggagggagggaaggaggaaggaaggaaggaaggaaggaaggaaggaaggaaggaaggaaggaagg

SEQ ID NO: 3495 - DNA, 201 bp, Homo sapiens
aggtctcctctgaactgtgttgctttgcttccccaagtagtcccttctccaaagcaagacctaattgtgtgctatataaagtcggcagggcattctgaccrccaagttccattctgagcaggaagaagtcaggcaggctggtgacctcccctgtccagttaccaaaatcgagagggctttaatctggggtgtagcccattg

SEQ ID NO: 3496 - DNA, 201 bp, Homo sapiens
tttagagatctgctttctgtagaggttgtcgtatgatgtccttgaatttttttatgtttaattctaagagagtggcataagttcatcaggcatgaggacawagagtgtgaaatcagaatatgtccccttgtcatggcaccatgaaatacatctgccaggagcagaagtctcaagatttccccaaaatctacttctgccaga

SEQ ID NO: 3497 - DNA, 201 bp, Homo sapiens
ttaaggttcagtcccaggactccacatgctgcctcgccagaggtcctgctccatcctgaggccatgtgatggcagagttctaatttgtgtcactttggggwctcactacttttctaccttctcaggctctgagaatccagctcttccccaaggttgagtcatgccccaaccaacaccttcatatccaagcattagaatcta

SEQ ID NO: 3498 - DNA, 201 bp, Homo sapiens
atcatgtgagctaattccttaaaataaatctctctgctttggttctgcttctctggggaaccctgattaatacattcccttttgagctcttcactggccaygtgttgcattcaaagttggaccactctgctgctctcaacatcctcaccctctttggtaagtccttgcccctgtgatgcttgctttggtcgtcaaagcagc

SEQ ID NO: 3499 - DNA, 201 bp, Homo sapiens
tacaggtatttcaggttgctcactatccaacctttactgagcacctactgtatgctttagcatgttgtccccatcattttggagaggacatagtcaatctrgtacatggtacaatcttttttccttccactcagcaacagcaaaatacatctggctcccgaaacagtatggttttccctcagatatttttctaaatcacat

SEQ ID NO: 3500 - DNA, 201 bp, Homo sapiens
tccaacctttactgagcacctactgtatgctttagcatgttgtccccatcattttggagaggacatagtcaatctagtacatggtacaatcttttttcctyccactcagcaacagcaaaatacatctggctcccgaaacagtatggttttccctcagatatttttctaaatcacattgatttgaattaaatagttcagaaa

SEQ ID NO: 3501 - DNA, 201 bp, Homo sapiens; identical to SEQ ID NO: 1835

SEQ ID NO: 3502 - DNA, 201 bp, Homo sapiens; identical to SEQ ID NO: 1863

SEQ ID NO: 3503 - DNA, 201 bp, Homo sapiens; identical to SEQ ID NO: 1864

SEQ ID NO: 3504 - DNA, 201 bp, Homo sapiens; identical to SEQ ID NO: 1865

SEQ ID NO: 3505 - DNA, 201 bp, Homo sapiens; identical to SEQ ID NO: 1866

SEQ ID NO: 3506 - DNA, 201 bp, Homo sapiens; identical to SEQ ID NO: 1867

SEQ ID NO: 3507 - DNA, 201 bp, Homo sapiens
ggtggggtgacctctgtctgtcacatggtgctgataagtgaagcacctgaggtccaagatgtaaccatccttctagcaatgtggaggtagctttggtgagygaaccacccattctttctcttcccaatataaaaaaacaaaaacaaaaacaaaaacacgagattaaagtctcaggttttattggtaaaaattaaagcttca

SEQ ID NO: 3508 - DNA, 201 bp, Homo sapiens
cccttgcttttagtacagcatccttagtgatccctttaaaacataaatacattttaaaacttaactcctctattcagaacactccaacagccctccatttycttcagagtggaatccagagttcctacaattgcactcacctttttgacccagcaatcccattactgggtatatacccaaagggttataaatcattgtatt

SEQ ID NO: 3509 - DNA, 201 bp, Homo sapiens
tggccaaacacttcctgggatttctctccttccagagacctctttaaatttccctagagtgtttgcaaaaagaactgcttttaaagataggcaaacctacytacgagaaaggagcaaatgcctgggatatctgaagttaatgcgtgttgttttggtaatctgctattttgaatgatgacatgagcaggcagtgtgtcattc

SEQ ID NO: 3510 - DNA, 201 bp, Homo sapiens
ctgggcctctcaaagtgctgggtttacaggcaggagccactgtgtgccacctgtcctcaatttgtaccttaatgatttcaacagctattgcttagtagctrtggagcaaagaagtacaaatttgtatgtttgctagattgggaatataattagtgaaatctagaagatacttttacagttgcttttgatgaggtcttatgg

SEQ ID NO: 3511 - DNA, 201 bp, Homo sapiens
cagagtggaatccagagttcctacaattgcactcacctttttgacccagcaatcccattactgggtatatacccaaagggttataaatcattgtattgtamagatatatgcacacgtatgtttactgcagcactcttcacgatagcaaagacatggaaccaactcaaatgcccatcaatgatagactggataaagaaaatg

SEQ ID NO: 3512 - DNA, 201 bp, Homo sapiens
gaccctgtagtctttcattccattggagtgctattacttatttgctatcctcttattgttgggtgtttgtattaatttttagtatcaaaagtaatgcttayattcaaatcattgtatgcatcatttgattcttccatataagctcctaggcctggagttacatggtcaaaaatgaaaatatattagaaattttcccccaga

SEQ ID NO: 3513 - DNA, 201 bp, Homo sapiens
ttccacacatgcccacttccaaactactctcctcatacacccaagagggacaagttaaacatgcaaatcagagcaggtcccgacactgcttatggtaacartgtataagctttccattgctgctagaataaaatccaacttcttttcctcggggttgttcatggtctggcctgactacttgcctgtctttccagattctat

SEQ ID NO: 3514 - DNA, 201 bp, Homo sapiens
atgccacctaagtcagcccatatatattttttgggtgtgtacaacacacatttgcctatttccatagccttccaacatacactttctcagagttctctttraaaattataggatcattcttattcctacattgctagcaaacccttagtagctcatcaccccaagctcccaagcctaacatcaaggccctctccatacttg

SEQ ID NO: 3515 - DNA, 201 bp, Homo sapiens
tcacagacaaggacctgagaaatgccaactacattccagaaattgttattcaaattgaaacctttaaggagattcttaaatgtatcttatcttggattttrtattttaaaactttttatttccagagtaagagcaaaaaagaaactatgtacttgtatatcacaagtaaacaatttcgggtccctggggtttgttattact

SEQ ID NO: 3516 - DNA, 201 bp, Homo sapiens
ttctgccatagaacttgtaagtttctagataggggctgcttctttattccagactacctctgtcctgaaacagaaacaaagtaacttgagttacagccaayccacaatgaatatgtgaaataagtgaaaaaataacccaaataatgaacccaaataataaacccaaataatgaacatatggagtttatgttgttttttagc

SEQ ID NO: 3517 - DNA, 201 bp, Homo sapiens
atttagcagagcaaaagttgtgaatcaataatgttttaatttgtcaaattttccttttacagaatatgctcttggtgtcaaggatgagaactctttgcctrattctagatccaagtgattttctcagatattttttctttaagctttatagttgacattttacacttaagtctgtgatccattttgagttacatttatata

SEQ ID NO: 3518 - DNA, 201 bp, Homo sapiens
cttttacagaatatgctcttggtgtcaaggatgagaactctttgcctgattctagatccaagtgattttctcagatattttttctttaagctttatagttkacattttacacttaagtctgtgatccattttgagttacatttatataaagtgagtcttttgtttcacttttttgactatcagtatccaagtgtcccaaca

SEQ ID NO: 3519 - DNA, 201 bp, Homo sapiens
catatgaccctgccaaatccccctctgtgagaaacacccaagaatgatcaataaaaaaaaaaaaaaaaagaaatgatcaaactcttccagagaggctgtaycttcttacagtcacaccagtgatttttcccattttctaattggaattattattgagttttagaatttatttatatattctatattctcatccttcatttg

SEQ ID NO: 3520 - DNA, 201 bp, Homo sapiens
ttgaacacttagaggccattgtaggggtatagatcagccctaattttaatattgttatatcctagtaaatagggaggcctgacgagagggagagagttgcrggaacagctggttggtggagcaatcagaacacacacaacatttatagactatgttcaccatcttatatgggtgcggttcgtgatgccgcacaacaattac

SEQ ID NO: 3521 - DNA, 201 bp, Homo sapiens
attcatcaaaagaatcactatccacggcagctatagccttacaaaatgtatttaagtaagacttaagtcaaaatgactccttgatccatgggaggcagaawggatgttgttttaacaggcatgaaaatattaacctccttgtagatctccatcagaactctaggatgatagctcttgggtgagtagtaatattttgaaagg

SEQ ID NO: 3522 - DNA, 201 bp, Homo sapiens
acacaaactttttggttccccagtgcatataaaatttatgtttacactatattgtagtctaagtgtgaaatagcattgtctttaaaaagtgtacatacctkaatttaaaatttcttaattgtttaaaaatgccaatgatcatctgagccttctgcaagttgtaatctttgctggtggagggtcttgctttgatgcggatgg

SEQ ID NO: 3523 - DNA, 201 bp, Homo sapiens
agatgtgctatcatccaggtgtggttccatttatagagcacaggcagagtagatttagcataattcttaagggctctagcattttcagaatcataaatgascactggcttccatttaaattcaccagctgcattagcccctaacaagagagtcagactgtcctttgaagctttgaagtcaggcactgatttctcctctcta

SEQ ID NO: 3524 - DNA, 201 bp, Homo sapiens
tgctgagctaaagaagctggaagtgtttataatattttaatcatacacgtacaagcatgtaatgttgtaatgtgcaagagtcagtctcctagattgaaatrttgtctgcagaattttccctttggaaatacatatttttttatgaagcacatgatgtgagtggagttatttcctgggaagtcagtttgggaaatactattg

SEQ ID NO: 3525 - DNA, 201 bp, Homo sapiens
cgaagcctgtctgggttcctaatgtagatctgcactattttgagacattattaagcctggagacatagttgaggacaatattgacatgggatgggcttatyctgatgcttgaaatcctattacaaatacccttaattaaatactgtatgagacacattagtcagacttggtcctagcctctgttggtcagaaaaatcaaag

SEQ ID NO: 3526 - DNA, 201 bp, Homo sapiens
aacagagtgtgagactccatctgaaaggaaaaaaaaaaaaaaaaaaaaaaaaggtggatgggtcagacctctgtaaatcaagggaaaagcatatgaaaggwaaaataattcttgttggaaaacacagaagtgaaagacatgaggtggaaaggtagtcaacattttaactcagaaagtctaacatgtcttatcctggagttt

SEQ ID NO: 3527 - DNA, 201 bp, Homo sapiens
cgctgaactctttattttgcaaatgatgctattgaggtctagagatgttaaatggctgcccaagattacatacctgactgcaatgttgcccctacaccackgctttaagactgatttgtgagtgtctgcagattcccaagtgagagaagcatgtgccatactacagatgttcttacccctatacctccccactctgttaca

SEQ ID NO: 3528 - DNA, 201 bp, Homo sapiens
aagaactagtacttcatctttgccaaagttatgcattgcaaatgtcaatttagctttggctactgcagggtatgaaaaggaaaaaaaaatcttgagtgtgmgtaattattgttaatgtaagttatctaattgggagtatttattttctgattgtagggcaaatgttagtgagtaaagcataggtttattttcttgtctatt

SEQ ID NO: 3529 - DNA, 201 bp, Homo sapiens
tgtatttagcgaggtatttatcttaactcttggaggtgttaggaatatgacaggagaagtttgtgctactgaaagaaattaatatacacattattatagayctgtttaaaatacatatatatataataattgcaaaggctgtttgtcaggaatcagtgacaaacttcttgattagtacattaatcaaggcaattaacgtta

SEQ ID NO: 3530 - DNA, 201 bp, Homo sapiens; identical to SEQ ID NO: 1169

SEQ ID NO: 3531 - DNA, 201 bp, Homo sapiens; identical to SEQ ID NO: 1170

SEQ ID NO: 3532 - DNA, 201 bp, Homo sapiens; identical to SEQ ID NO: 1171

SEQ ID NO: 3533 - DNA, 201 bp, Homo sapiens
tggtttttcttcatgccttggtctgtttctaacaaagatgttattttgtaagtcatgggtacatatatgttgatttgagtgtttcttgcaggaaatcatcygagtacttacacgattgcttgagtgagaacacaagatcccataaaaacaaagaatgaattcagtgtattttcttcagtcagcatctctcctaagattaga

SEQ ID NO: 3534 - DNA, 201 bp, Homo sapiens
gggccctttgagggcacgaagaacttcaatatatcatcaagttgggtctgctgtactttccattgatttgtctgtttattctctcattgtatttataaatsgcaattcaaaattataaaagcactgtctatcaaatttataactactggaaattcattcaaagttttatatttgatttactgtaagtcctcaattttgagg

SEQ ID NO: 3535 - DNA, 201 bp, Homo sapiens
tctagtgaaaaagtacaggaagttagattttagcatctgtggcagtaaaaaagctcaaaataaaatcgaagaattttacttggctgaaaagcaattgtgarggaaaaagataggcttgagtgcataagattattaaaagtacaataccacagccaccttttgtttaagtatacacaaatggcagagcttgcacagttttaa

SEQ ID NO: 3536 - DNA, 201 bp, Homo sapiens
gtgggttccaatacactcacaataagtatggtataatagagttctggtttatagtgcttcctgaccatgtagtatgagtgcatacctcttagagttctccktttaacatagataaggggaccagcaataataaggtaaagagtagcatactcatacccagcaggcacaaaagaggtgtttacccagaggagggggttgagc

SEQ ID NO: 3537 - DNA, 201 bp, Homo sapiens
attaaagaattctcaaggtgacactttgggtgagagagacagataagaatcttagcttggtccatttgcaggatacagaagcaatgacccctagtagcaakgaatatacctagtgcctagattgtgatttcttaacatcattcttcagcaaaagaaagtaggatagtttggttaataatagggataaagcagaaaaatatg

SEQ ID NO: 3538 - DNA, 201 bp, Homo sapiens
tatcttagagatttaggctgaatctcattagataaattaagttcccaattgccataaagtagagataaattagaactcaagaatcattttattttcaacayaatttaatctcaaaagagtactgttaatgagaaaaacataatgattcttaagattctaattaacttaccatgtgagatggaggggaataaactgaagtac

SEQ ID NO: 3539 - DNA, 201 bp, Homo sapiens
gggcctaaggagatggagcctagtctggcctagtcttcatattcttcagtctccaccagcccaataaagtcagtgtctgactccctcagggtgcagcaagmctttgactggtggccttttcatttcacagccctggccattttcttcactgctctgtggacactagtttttccagtgtcccttctttttgccttgtgcacg

SEQ ID NO: 3540 - DNA, 201 bp, Homo sapiens
tgaccgtatttgaacatttgggacaaaacacataatgtacacttctctccaaagtgaaatcaaaaggcacaatacaaccatgctgtggttgaaggatgtarcatagtttgaaacaaaaataagggaaaagaattgaaattgcttgtcttgtcccttagtaatcttcactgtccactcaattttttttataacagaaggtga

SEQ ID NO: 3541 - DNA, 201 bp, Homo sapiens
tctccgtgagattgggcctattggtaggtttaataaatatgaaatattaaattttctaattggatatttctgtgtgtgtgcatgtatacacttacacatayacaagtgcagttttttgaattgactttttatttaatcaatttttataaaagttcttggcagtaactttgattcacacagccaaatgtttggtttttattt

SEQ ID NO: 3542 - DNA, 201 bp, Homo sapiens
tcatggtttaaactgactgacttttatttgctccatacaaacatatctgtcataaaaaccaaatatttcagtctaaaagttctctaagatgcatcaaaatmattgaattaggagtgtgagagacgtctaataagtgctgtcctgggatctcctggctcatgcctaaggaaataaattaatatcaattcagtgattaaatgc

SEQ ID NO: 3543 - DNA, 201 bp, Homo sapiens
atccaacttgctactgtaccctattaaaatgggttttctgagccctgtttagtcagatttaaccccttgggtagaatcacagctagaacctgacaccctgrgtcgaaactgctaattggtgcctcagagtcacagattctggctctgtggtcaatctacaccctaccaagccacagagagtgaatcatcagccaaagacca

SEQ ID NO: 3544 - DNA, 201 bp, Homo sapiens
ggcagttcctgcaaaagtggtttttcctgtggctttccctttgttttggtggctgacagcgaagctgatttttctttcactgtaggctcagctcaggacaygagtgttttgcaataagctgctaagcagggctacagccacacaggctgagtttggactatatttagccatgagtcaatataaggaaattggtctgggtgc

SEQ ID NO: 3545 - DNA, 201 bp, Homo sapiens
tgcatatcccagtacttctttaggtacgtaagctattttctttctaataaaccgctattgctcaaaacttctccatacactccacacctcccctttttgcwcgcttcttcttttatttccttatttgaagtatccaccccaagtttttccctctgaaatttctgcttgttaaactctatcactccctccatgaagctcttc

SEQ ID NO: 3546 - DNA, 201 bp, Homo sapiens
catcaaacatagtcatagtactaagaagagattcagtataaaactactgttacaaaaagggatgagagagtagctgcaggctttcattttgctaaaccacrtgactatccttctcaacagaatgtagaaacctgcacttttggtacttttattttacataaaacattcttctattagtttatttttctaaagcattttgca

SEQ ID NO: 3547 - DNA, 201 bp, Homo sapiens
aatcgaaataggaagatagttgatcttctttaaaaaatattcatgttttgtctgtgtctattttttcttgatccattgtggtcagagtggccttgcccaaygttggtgttcaatgcaattgtttatgggcaacaggggaacaccagggcttaggtaacagtgcgaggcaggctcctgaatgtcaggggttgcttttgtcta

SEQ ID NO: 3548 - DNA, 201 bp, Homo sapiens
aaacatagctggaaggaggctcacagctgtaaagactggtatgtgaacatcagggtaggagaactgggggtggggtgtggatgcttcccagaaagggaacygggaaaaccatttaatgtgtctactgtaattctttctggttcagtgagccttttagtgggcagaaaatgagttgctcccaagttttaaaatctctcacag

SEQ ID NO: 3549 - DNA, 201 bp, Homo sapiens
acagccaaaccatatcaccctgtctcaaaagaaaaaaacagaaagaaagaaaagaaaatttaaaatgataaatacttgtcccattataattttactggacwgttggtctagttttgatgagaaagcatatagggaatactttaccctagctctacactatacctgaaagcatgggattgaatgatgtctcaaaggagggaa

SEQ ID NO: 3550 - DNA, 201 bp, Homo sapiens
taaatcccagtaagtaattcttgtctgcatttctttctatattgcagtatcaaaaaaatgagacattaaaggaggaagagagaaaacgatcctatcaaaasggtcagttggaacaaaaaataacaataatgccaacagagaaatgagaggagtgaaaaaagcagaggaaagccagagaagaacagaaatgagaggacagag

SEQ ID NO: 3551 - DNA, 201 bp, Homo sapiens
aggagctgtgcagatcacagatctgaggtgaccactgtgtccctagtgaacaagatgccactctgtactgtcccttaaggggcctagaaaatgagctgagrctacaaaagttggttaatcaacaccagaccttgatgttggaagagagaaatggtagaacactgtgccacacttggccaacaggatgtgtctgccatcctt

SEQ ID NO: 3552 - DNA, 201 bp, Homo sapiens
ttggaaacttcaattgaagtgatcgctgtatgccacaagtttttatatatactatgttcactgatttagttacaaatattgtttgatagctatttaacttkcttcattaactcatgaattatttagaagtccatttttaaatttccagctatatggggaagttggggctattttttatagttggtgccacattttattaaa

SEQ ID NO: 3553 - DNA, 201 bp, Homo sapiens
tatggtttgaacacagtggtaatttttaaagtggttatcacctgtaacagtcttctctaaactaaagatctgacaagaaaatgacatgatttggggcgtaytatgcataattggtatcacagcaatattaggggatatgagacatcagccttcctgatacttcgatctctttaaaaagcatggaattataaaatcttagtt

SEQ ID NO: 3554 - DNA, 201 bp, Homo sapiens
ctttcatgaactgttagcagtcccattatattggctctttcctccctaactcatatgtggtaaaattaaagaaggaaggaaaggaggctgaatgaccattrgtcatgaaaacctcaatattccaaaactctctcaaagagcctctcttcctcaggatagtagtttgaaaacagaaaatttgggaaggccacttgggataat

SEQ ID NO: 3555 - DNA, 201 bp, Homo sapiens
ccttaactcaatgtacacaagagttgaacaagcaaccacattccaggtcctaaatttgccttctctcctagctgcaaatttggtggctggtggatttccakatttccatatataagataatgtgtttgtgtgtgtgtgtcaaagcagaggttcagggagagagaaggcaatctctcttaaatctgtatttgcataaaaata

SEQ ID NO: 3556 - DNA, 201 bp, Homo sapiens
tgaaattaaacaaaaaattattaaaggatttgtttccaactggataaaaaggaagatggtaaaggaaaaggaatcttctaagaaaactgtgactctttaayatcttaatagaacatatattagtcaaatgtaatattaacagaaatgtctcatttgtaccagtcaaacaataaaattggcttctagacgagatattttcat

SEQ ID NO: 3557 - DNA, 201 bp, Homo sapiens
aggctggagtgcagtggggtgacctcggctcactgcaacctccgcctcctgggttcaaatgattctcctgcccagcctcctgagtagctgggactaaaaaygcacaccaccatgcctggctaatttgttgtatttttagtagagacagggtttcaccatgctagccaggatggtctcaatctcctgaccttgtgatctgcc

SEQ ID NO: 3558 - DNA, 201 bp, Homo sapiens
tagttacatcgttagattttctatttttaaaaatttcctctggacacactttattttcccaaactatagtaaataccacagcaaacaaaaatttttgcaarccttatggaattaaaaaaacaacacttagaatcaaaggacattcaactagtgaattattgcacataagtcttaaacttctttgactctttttgtgaacag

SEQ ID NO: 3559 - DNA, 201 bp, Homo sapiens; identical to SEQ ID NO: 1295

SEQ ID NO: 3560 - DNA, 201 bp, Homo sapiens; identical to SEQ ID NO: 1296

SEQ ID NO: 3561 - DNA, 201 bp, Homo sapiens; identical to SEQ ID NO: 1297

SEQ ID NO: 3562 - DNA, 201 bp, Homo sapiens; identical to SEQ ID NO: 1298

SEQ ID NO: 3563 - DNA, 201 bp, Homo sapiens; identical to SEQ ID NO: 1349

SEQ ID NO: 3564 - DNA, 201 bp, Homo sapiens; identical to SEQ ID NO: 1350

SEQ ID NO: 3565 - DNA, 201 bp, Homo sapiens
atgtacattgtctgtgtgatggttatactaaaagcccagatttcaccactattcaatataatcatgtaacaaaacctcagttgcacaccataaatttataygaaaaaaagcatgctgtccaaagcaatctacagatgcaatgcaattcctataaaaacaccaatgtcatttttgacagaattaagaaaaacaattctaaaa

SEQ ID NO: 3566 - DNA, 201 bp, Homo sapiens
cacagcaaaataatcatcaaagtgaagagacaacctgttgaatgggagaaaatatttgtaaactattcatccaacagggcactgatatccagaatattcamgaaattcaaacaactccacagtaaatatgcaaataatcccattaaaaagtaggtaaaggacatgaacaaacatttctgaaaaaacatacaaagagccaac

SEQ ID NO: 3567 - DNA, 201 bp, Homo sapiens
aatacatattgtatgatgtatatatctacctatttttataaaatttctagaaaagaaaaatctatagtgaaagaaagcagatcaatgctctcctggggctraggttgggagagggattcattgccagtgagcatgtggtaactttttagggtgatggaaatgttctaaaacctgattgtgggattggttgcacaaccataa

SEQ ID NO: 3568 - DNA, 201 bp, Homo sapiens
gacaactgacaaccactgctatgtaaagatataagagaacagaagggtctacagctcacctgacggggaaagggtggtcagagagaggctgaatcttaatraatgtaacactttgtcagatatataagagagggcagtccttctggtcggtgccatggccaagctctgcagccagtgtgctggtctgaagggccagcggta

SEQ ID NO: 3569 - DNA, 201 bp, Homo sapiens
ctgatagatttaaatgggcatggtggggcagaaaatgatctgtagagtgattccattgccgtgtacagtgcatctgtatgtatggcctaggaaagggtctragaggcactccttgcctccagatggggtgcagggctgcttgatgaacttggggtgggtggggtgagagatggatcctttcctgacttactgtcctataag

SEQ ID NO: 3570 - DNA, 201 bp, Homo sapiens
taggggggatgtctgatacccttcctggttttcctgagtgttctttgtctccccaactcctactcacaataaatctgactacacttaaacttagatcatcrtaagagaccccgcaaatgcccaccatcctccactgctgtgatcatgaatctagaatggacatttcatatcaatgccacagtcccctgagaccatcagcca

SEQ ID NO: 3571 - DNA, 201 bp, Homo sapiens
ctctaacaaaataaacaataagcctttaagatgatctaatacccagtctcaatgttcaaatttcccagattgtttcaaaagtatctttttataaatagtcrttctggaagcaaacaagattcaaatactgcatttggttgttatatctattttattctgagaccacccctcttcccaatttgttctaataccatttatttg

SEQ ID NO: 3572 - DNA, 201 bp, Homo sapiens
cccttgtctacaccctgaaggtgtaacatgagggatcccatctgctatggtttgaatgtgcgtgcccgctccaaaattcatgctgaaacttaatccccagygcaactgtatcggaaggtagggccttctggtggtggggttgagtgctctgccctcatgaatggcattaatgccttataaagaggcttcacactgcgtctg

SEQ ID NO: 3573 - DNA, 201 bp, Homo sapiens
aatgaggggtctctttttatcatcgcgagctcatggatttctatatttattacctttccatatattgcagtcattattcttttgcaatgttaaaaatgaayccatctttggccagtaggactctccagctggcttctggaccagtttttaagagcttttctgctttctggtaaaatcacatgtataaagctcatcttggac

SEQ ID NO: 3574 - DNA, 201 bp, Homo sapiens
ttgctcgggactgagatgcttggtcaaaatacttggaattacagagaaaaaaattcccagggggtcaaagcaggtgtactcaatgtggaatgcaaaattcrcagagttagtgttgcctgcctgcttttatctggtcagagattccagggagctgtggggctcattcatgcttgaaggattatattaagatgcctggatctt

SEQ ID NO: 3575 - DNA, 201 bp, Homo sapiens
cgaagggctcagtttcatctagggtcacatctgtgagaagcatgtcaagaagtttcctcagtgcccaatctggagataagtcaatgaggcaaagctgggtmtaaccttgaagaagacatggttggccttcaggagagctgcttcagggaggcaagggggctggataagaagccagtctgagaagggagccatcaaaagtgg

SEQ ID NO: 3576 - DNA, 201 bp, Homo sapiens
actttacaagacataatgtggtcacatcccatctcttggcccagatttaagagcattggggttttaaaggcccagtggcttaaaagcaactaaccgaccaracagaatcctacccaaatactgcattacatttaccacatgaggaaatttagcattataaataattcagcccaagtggcacttctcagtgcagatgaactc

SEQ ID NO: 3577 - DNA, 201 bp, Homo sapiens
atgctgtcatctgcttcattttatggacaccagtgattttcctgtagtggaataactcttgattaaatattttccatgctcctccacatttcctggttctrcagctcttgtttccctgacttaaagcaaaaatattgcttggctaagataccatgctctatttcaaatcagtttgccactaaaatttggttattggaatgt

SEQ ID NO: 3578 - DNA, 201 bp, Homo sapiens
agaatttctggcatggctaggagttgtctggcctagaaagaaaggaacctaatctagtttctctactttccaactcagtggttacaaataattagttactyaaatctagatttttgtaaaattgtaattaattaaacaaatgtgttaatactgactacaaacataaaaatattaatcttctcaaataaaatatattatttt

SEQ ID NO: 3579 - DNA, 201 bp, Homo sapiens
tcttttctattaacaataaaattttaattagaaaaaatgaaagagaaaataatccaactaaatagcaataaaattattaaatatatccacgaataagcagmagaatgtgtaaggtttttataggggatattatgtaattttattgatgtacatataataaagcctgaataaaagctttaaaatatgaaaactcaataaagg

SEQ ID NO: 3580 - DNA, 201 bp, Homo sapiens
tatattattcgaccagaaaatccacatttaatatccttattttcttccacaatgaaggctttcttagatactgcccttgagcgtgtgagatcacaactcaygttcacgctcagtccaatcaaggatgttccaaggctcctcctcacatgttcagctaaagtttcccaatcatactcccaggcagctaggggagcaagggct

SEQ ID NO: 3581 - DNA, 201 bp, Homo sapiens
cccttgagcgtgtgagatcacaactcatgttcacgctcagtccaatcaaggatgttccaaggctcctcctcacatgttcagctaaagtttcccaatcataytcccaggcagctaggggagcaagggcttccagtctcagccccatggcatcacaatattggtatccctcccctataacaatttaggcaaaaggtcaagaac

SEQ ID NO: 3582 - DNA, 201 bp, Homo sapiens
aggaaagctatatatatcaagaaatgcggacaaataccaaatacaacatgtgttctgccttcttacagagaaagggttaaggaaccacacctccaacttaraggccaaggttactttattcagttaggagaggaggcactgttttcatagagtaacgaaccacagtttttctgccccacagaattctaatgctgtcaagta

SEQ ID NO: 3583 - DNA, 201 bp, Homo sapiens
ctatgaaagaatctaaacggtttcttttgtctctgtttcttgctgaagagtcacagtcccatgttggccgggcctgggacatttgcttcccttctggctgrtggtgctccaaagagaaaggatgtgatctctttggtttcttcccacaaggaaaaggtagttgttgggaacctgccccgtatgatgaaagtcatctgcagt

SEQ ID NO: 3584 - DNA, 201 bp, Homo sapiens
tccagtctaatctacaaaatgacctatatgataccacttttcagaatatcaatagtactctgaaattaaaatgttaaaactgagcttataatttgccccascctgcaaaaaacccccaaccaatcaacaaaaacaaacaaacaaataaataaatgcatgcttgatcttttccagcatcttctgtcacaatgaatggtacca

SEQ ID NO: 3585 - DNA, 201 bp, Homo sapiens
ctattactttttgaaaattacttaaaaatctctctatataattatccttctatttaaagctgatgtttattacattccattattcataagtagctttaaayaggattatccatattttttccaagtgtttctgctctttagtaatctgacagacaagccaactcctatgtttaacattagcttctagaattacaaggggtg

SEQ ID NO: 3586 - DNA, 201 bp, Homo sapiens
atttgaattttaaaataatgggaaggtggtgtggtaaggtaatttgctctccatttgtgctaaaaaattttatctctacctcacataaaataacttccagrtgattatacaatcacaaaaaactactgacattaaagaaaagtgcaagagattattttgacaatgtggaatggagggaacctataaaagccaacaaaccta

SEQ ID NO: 3587 - DNA, 201 bp, Homo sapiens
tgtatagtggtgaagtcagggcttttagcttatccatcacctgaacaatatacattgcactcatcaagtaattaaagtgaaactcgtgtcatgtgaaattraccactttaaagtgtacaatcaatggcatttagtacattcacaatgttgtgcaaccactacctctatctagttccaaaaggtgtaagcaacccaatgtct

SEQ ID NO: 3588 - DNA, 201 bp, Homo sapiens
attttgtggatattgagaaattgtttctaaagttaatatggagtggtaaaaaaatccataataaacgacaacattttgaagaagacaaagttgggcagttracactacccaacattaagctttactataaaggcacagtaatcaagatcatatggttggtattggcaaaagaatagggaaataggccaggcatggtggctc

SEQ ID NO: 3589 - DNA, 201 bp, Homo sapiens
ctgtttttctgccccttgcaacttggagatcaaggaagagcacattagtggtgtttatagtaggagtttccctgcatgctagtttccatgtctgcaggacrtacagtgttctgtgagatcctgaatgcgttccccaaaagtttgtgttgaaaactcaattgccaggcataagaatgatacaatggactttgggggcttggg

SEQ ID NO: 3590 - DNA, 201 bp, Homo sapiens
tggtgcattgtgggtgtccacccactgactgtgagagatgaactttctgtgtgatggctcgtgcacttctaaacgttggggaaagagagctttgtgagatrgtaacctatgattgtcccctcccactcaaggacataggtagcaggctctgtgctgcttctctgcctctggggaggtttgtgacctgacttttatttccaa

SEQ ID NO: 3591 - DNA, 201 bp, Homo sapiens
aaatataaagttagaaatgaaactccaaaaaataggttgttaaattacttatggatttaagccaaaaaatgtacttatggaaaatgtctgtgttaaaaaayacatacagtaaatgacaaaatactttgaactaaatgacaatgaaagcaatgtataacaaaatatgtgtgaattaaacaattcttagagaagtatatatag

SEQ ID NO: 3592 - DNA, 201 bp, Homo sapiens
tgagggggcctattattattatttgcagtctttattttagttcttccttatacatagctcaaagtttgtctcaggccttgtttattcatttttcctcattkcctagtgaatgaaaaaagtatatcaaaaccagaagggacccttaaagtccatttgacaaaatcaagaaggatccagaaaaagagatcaatgtgagagaag

SEQ ID NO: 3593 - DNA, 201 bp, Homo sapiens
gtaaaatctgatagtgatagtgcaatgaagaagaataaagtagggtgagaagatacagataacaaggagaggaattccaaagatgatggtcatagaaggcytctccaaagtgatgacttttgagaatctctggaaagaagtgaggaagtaaactgtgagagtggaagaatggcatgcaaaactctcaacgacagacatcag

SEQ ID NO: 3594 - DNA, 201 bp, Homo sapiens
ttccctaaacctgtaggcttagaccttcactggagaaatatcagcgttgaagatgaaatagagcaactgaaattcttatacattgcttgtgggaatttatratagcaaaaccactttggaaaactttttagacattgctaacaaaattcaagatatacctaccctgtgacgaagaaattacactcttaggtatacatcaaa

SEQ ID NO: 3595 - DNA, 201 bp, Homo sapiens
tggcccgctctaggagcttaacgtaaggatttaaaattaaaagaacaaatatttaaagcatcccaggcacacctgaccttaatgccaggaactggagtacytgaaggagttacagacaaattagcagctagtaacccatgaaaatggataaaaacacttggaagctctgtgatttcaatgatgattgtgcttttaatctgt

SEQ ID NO: 3596 - DNA, 201 bp, Homo sapiens
gaagagaacagcagtatagaaaagagcattgtagacatataaaaatgactgctacgacccatctgatgattcttcctttgtttttgcattatgcacaccaytacctagaattttaaatgttctctctcagcatgatgcttattatttaatcatggaagacatagagaaggagaatgggagttgaggaaaattttgccttga

SEQ ID NO: 3597 - DNA, 201 bp, Homo sapiens
gacactaccattgtgtcacagaaagtaaccatacatagggatcaactaaaaacattaaatgactttcagaaattactaggggacattacttggatacgacmtgctctaggcattcctacctatgccatgagtaatctgttttctatctttagaggaaatcctagtcttactagccctcggcaattaacaaaggaggctgag

SEQ ID NO: 3598 - DNA, 201 bp, Homo sapiens
gaaagagaaagcccaggcacagaccaacaatgattctgtgccagccatgtctgagaactactgccaactcaattctgacatggggatggaaataaattaawcagtgaataaataatcaaaatagataatttaggtacattattttagaaatataaatcatagtttgacatgataacctataaaaatgtgggaggaaataac

SEQ ID NO: 3599 - DNA, 201 bp, Homo sapiens
ccctgtggtgagtaagaaggggagcttggaagcgtcagggtaacaatgggacaggtgtggggtctggttcatttcaccttggaactttttcacgctgatgwtgaggaggaacaagagtatagcgaagtaacagaagaggttacagagcatgtttatttgccagctaaagctaaagcggcaaaggagtgagaggttcatccg

SEQ ID NO: 3600 - DNA, 201 bp, Homo sapiens
aataaataaaaaacaaactcatcaccaatgcaggagcttctctgatgttctccattaccttgcttcttccaagcagtaaatttagagacctgcctttatcyggtatttgtccttggctatgacattccttcatcaccccctatatgcacgatcagttgccacgttctattgattcaatcttctaaaatctctggaatccac

SEQ ID NO: 3601 - DNA, 201 bp, Homo sapiens
ttctttcacacagctcacttcaggcgactgctctttcttggtcactgtgtgttgacgtaaatgtggaacatagcccctttaccttcaattctacaaagcgytactcattacaacccattatgtatggtagatttttacaaaaattcagggtaatgaccggtgattatagtgcacaaagcccaacaaagcacaagaagggaa

SEQ ID NO: 3602 - DNA, 201 bp, Homo sapiens
ccacgacatgccagaattccactactttctctttagtcaacatttgcatgctgcaaattatcacgcgggcagggcacttttacaaaacagttttgagaatktcatcactttcttcaaaaaccttttaatcttttcacatttaaatacacatcttaccttagttatttcttgtctttgatttttttatctggttgaaatatg

SEQ ID NO: 3603 - DNA, 201 bp, Homo sapiens
ttatataacaaaaccgtttattattcagctgctgtgagtggtccctaaataattgttattttttaatagctcagaactgtttccagtgcaacataatttamatataagaatctggaattaagtctccaattttattatatttagaggccctgatgtccatattgccagtgataaagggacattgatagttcatagcatata

SEQ ID NO: 3604 - DNA, 201 bp, Homo sapiens
tcccatcaccagagcaacatacactgtacctaatttgtagtcttttatccctcacctccctccagctatgaggatgcaaagccatatattaaatttttaamcccagcacctcagaatgcaactgtatttggaaatacgctccttaaagaggtacttatgttaacatgaggtcactgtgaggtggattagataggatgggca

SEQ ID NO: 3605 - DNA, 201 bp, Homo sapiens
agcctcatctttgtctattctctttctttgtaacataacctcagggcattccacactacttttggttctctgaaactaccatgttttgctcaccttctggrctttggtttgtgcggttatagatgtctaaaatgatttctcaaatgcctaatttttttatccatttaatttctatttattcccaatgatgtgcacccaact

SEQ ID NO: 3606 - DNA, 201 bp, Homo sapiens
gtgtagtggcaaggggatctaatgcagggatcccgacagcctttgtcatggtggtaggctgctcttgagattagctgaggggtgtccaggtcatttcttcrttaccacattggcaggaattcttggaccaacacactatctcatttcttgtctccacaccagtgggcaatgtgtttctgtggcagctgtgcctcttgttgt

SEQ ID NO: 3607 - DNA, 201 bp, Homo sapiens
aacatattagagtgtagagcaatttcatttttgaaatgctctgctatgatttgaatgtttttgcctcctccaaaattcatgttgaaacttaatcctcaacrtaacagtcctccagtattgggaggtgtggcctttggaaggtgattgagccatgagagctccaccctcatgaatggcattaggtgcccttacaagtgagct

SEQ ID NO: 3608 - DNA, 201 bp, Homo sapiens
aggacttttgtttgaattatttttatattcttcataatacattcacaatatatgacacataataggaactctaaaaattgttgagtaatccatagatccaytgatttatttatttacttgtttactaatggaatattttgaatacccattgctcattgtattaacccatgtttcctagaaatggagcccatggcgaaaact

SEQ ID NO: 3609 - DNA, 201 bp, Homo sapiens
tagtaggccagctaattaggtgtgattaatcagctctgaaccatgaattgttcttgtgtaagtgttgtctctttagcttatgagctttgatgactagctgrgctgcttctgatggactgtatacaaagataggctttgcccatatatagaaattatgtcccatgacggagatggaagaaaatagctagtctggaagcagca

SEQ ID NO: 3610 - DNA, 201 bp, Homo sapiens
ttaggaaaaaaagtgggtttgcagcttattgaaaattaaacaagaggaaaaaattgaagaaaaaaataaaggaaggaacaaaatataagaagaaataaatyccagtgtagatcaggaccaaccttattttatgctatcatttcttgaagtttggacataaatatagacagtgtttatcaaaagacaagaaaaagataaatt

SEQ ID NO: 3611 - DNA, 201 bp, Homo sapiens
ttcaagttgtacatagcacatagggcctaactctttgattttgagtttctactaatgactaccctttattctgatgtccactctagctttctaaggcctawgtccacaagaggccagatgaattcaaagaaggattcatagttcccttgggactctttgaacattttttcatttgtttcactacaaattattttattattt

SEQ ID NO: 3612 - DNA, 201 bp, Homo sapiens
atgtcctttcgcatctcatgggaatctccactaccattccaatatctaatttttttgatttatcatcaaatgaaggaatccttattcctggatttattcarcactgattttcagcttctactgaattctttcacacagctcacttcaggcgactgctctttcttggtcactgtgtgttgacgtaaatgtggaacatagccc

SEQ ID NO: 3613 - DNA, 201 bp, Homo sapiens
ttctcagagaagcaatagatgcagacattaaggctataactcaacaatcagatgaatcctcatgatgcgttctacacaagaagaaacagaacttccttagrgaacatcatccttttacaaaatctgaaaagctgatattctgtggcacagaagcaatctcatagaaaatacatattcagtacttctcatttattaagccat

SEQ ID NO: 3614 - DNA, 201 bp, Homo sapiens
agcagtatgttatcagctcagatgggccctttcttcatcacgtggggtgaatgccctctgctggtgagggtaaagggccagtgtgacagccttttttgtgyacccgtagaggtcgcatggacacttaaaggatggtgaaggtggagaattttattaagcaatggaaatggctctcagcagagaggggagctgaaaagggga

SEQ ID NO: 3615 - DNA, 201 bp, Homo sapiens
ctttaacgttaaattttcctaagcctctttaccaatagaaataagtactttttcttgttttatgagtttgatctcttcttgcttaaaaaacctgtaatagmttcttccaagatggaagtctggcagggaattgctaattctccacagcacctgctcctgtcacccctcacttctcatttctcaattctagatctaccccag

SEQ ID NO: 3616 - DNA, 201 bp, Homo sapiens
aggaaactttatctcttataaccacaggaatcagcttttctgaactcaaaacccaaagtcttattttttggatgagtggcagctgaattacaacacagatygaattcacaacctcatatatcaaagtgagggaattgtttgcaaaaatagtacaaaaccccgtaagtcaacatggacagattctgaagatactttaacgtt

SEQ ID NO: 3617 - DNA, 201 bp, Homo sapiens
gtttaatgcctgaaatgttatcatattgtgtagagtcatttgtagcctactgtttggtacttgaaaattgaaaaaaaaattaaacatctccacatgtccgygcatactcaaccttatgtgagaaatcggaatttatttatatttttggttgctctgcaaattggtagaatctttctacaagatcatttgttaatgcaggaa

SEQ ID NO: 3618 - DNA, 201 bp, Homo sapiens
gcttattctaaacatagttatttattttaaattcaaatttaattgagcagagtgcatttttatttgctaagtctcacaaccttaactctgaataagaaatkagataatttaacaacaaaataataattaaaattaacattaattcaaaaatgcaaaaaggagtcaaagagaaaaaatattaatctacaattaggattaaaa

SEQ ID NO: 3619 - DNA, 201 bp, Homo sapiens
atcttgcagtactcgagtaaaaagtgctgaaacaaaaaacaaatagaaaacaaaacccacaatgaagagaaatttcaaaggaacacaaaaaccaattaaakagctcccagtgatcaaaaccagaacaatttgagctacaagataaatgaattagttttatattataatgtgagatataaaataaatatcaataaattcata

SEQ ID NO: 3620 - DNA, 201 bp, Homo sapiens
tcttgctaaagagattacaattgctcatgcttctagatttaattaccactttttatagaatgcatagaacagtgaaacatgataaactatacaacaagaaygcaatcagtaaaatttgtatcctggaaaagtttatcagagaaataaccaaatttctttggcaaaaaatatacaaaaatcaaaattaaagagaaaggagaa

SEQ ID NO: 3621 - DNA, 201 bp, Homo sapiens
tcaaccgttaattttactaactcctaaatttctacatcttctgtgatatatatgatcttactgtgcagtctgtttatattatatttgtaaaataaccagartttctgacaatcagagatagacttaaggtttatagcatgagctgtgatagacacccaatgttaaacagagagggacatttgagtggagatcaatataatt

SEQ ID NO: 3622 - DNA, 201 bp, Homo sapiens
ttaagaacctgctatatgtgccaggcattatgttagaaatcagagatagaactggagaagggagttaggggcaaaaaacaaaaacaaacaaaatatcccasgtccttaaagagaacgcctagaaagagtgactttctctgaatatgaggtcatcattgatttatagtttgccttccttatttgtttatttgccagacttgt

SEQ ID NO: 3623 - DNA, 201 bp, Homo sapiens
tacaccatggaatactatgcaaccaaaaaaaagaatgatatcatgtcttttgttggaacatggatggagtggaggatgttatccttagcaaactaatgcasggacatataccccatgttctcacttcaaagtgggaggtaaatgttaagaactcatggaagcaaagaggggaacaacacactggagactatttgagggtgt

SEQ ID NO: 3624 - DNA, 201 bp, Homo sapiens
tgtttttgacatcaagttggcccatagatttgacagcctggtacccatagagtccccacccaagaacatttccttcaaaacaagctcctgttacagaaacrgccctggttttaaatatactcccttctctcataaaaatgccccagccagctaaagtcattctatttaaaatatttaattaataccttcacagaggtctgg

SEQ ID NO: 3625 - DNA, 201 bp, Homo sapiens
aggtttacagcaaaattgagaggaaggtacagagatttccaatatactccatgcacccccacatgcagagcctcctccattatcaacatcccccaccagcrtggtacatttgttacaactgtcagccaatgttgacacatcataatcactcaaagtccatggtttacattagggttcactcttggtgttgtacattctgtg

SEQ ID NO: 3626 - DNA, 201 bp, Homo sapiens
cgccccaacgcatagtaagtgctcggtcaatatttcctgagtcgagtgaatgggtagttttggaagtcaaatcttggaagagcatttctctgtttcctccrggcagaccctgcaggcatcagctccaggaggcattcgtcctgacggtcccctaaaccctgctgacacatgagcagacactgcacaactgcactggcggtt

SEQ ID NO: 3627 - DNA, 201 bp, Homo sapiens
ttccaacttgtgtatgacacttcttaggctatcatttcattccaaatttatggtcactaccctactgtcattcctcatactaaccatatgatcaacagttsaaaagcagccactcgcagaggtaagcaagatatatggtaaatactgtgttgacaaaagtatgcagaagcagtcacatttatacagtagtgaaggaaatgt

SEQ ID NO: 3628 - DNA, 201 bp, Homo sapiens
agtgtcactggaaagtgacaaagaggacagttaagttagttggaactgaactgaggccagacagggctgtgggacaagtcagggtgtggtcattccggtargcagcgatgcagaatcaagacagagtagtttctccttctctctctctctttaattgtaacgccttttataacaaacaaatattatgcttatttctgtctt

SEQ ID NO: 3629 - DNA, 201 bp, Homo sapiens
tgactctgaagatcatacccgaagtagagctgcaaagatatttggaatattggtaatatccaataaagaatgaccttcatgctattttgaggagatgtttmaatgtcgaattattgaaatatttataaaatacaaataaactaactctgcttcatattccaacttgtgtatgacacttcttaggctatcatttcattccaa

SEQ ID NO: 3630 - DNA, 201 bp, Homo sapiens; identical to SEQ ID NO: 1664

SEQ ID NO: 3631 - DNA, 201 bp, Homo sapiens; identical to SEQ ID NO: 1665

SEQ ID NO: 3632 - DNA, 201 bp, Homo sapiens; identical to SEQ ID NO: 1666

SEQ ID NO: 3633 - DNA, 201 bp, Homo sapiens; identical to SEQ ID NO: 1667

SEQ ID NO: 3634 - DNA, 201 bp, Homo sapiens
cagttaagttagttggaactgaactgaggccagacagggctgtgggacaagtcagggtgtggtcattccggtaagcagcgatgcagaatcaagacagagtwgtttctccttctctctctctctttaattgtaacgccttttataacaaacaaatattatgcttatttctgtctttaaattttttgtagtaatttctcatca

SEQ ID NO: 3635 - DNA, 201 bp, Homo sapiens
ttttctagttgagctatcattcatatttattatgtggaactagaggtagtcctggctacttgggaacagcgtggagtctagccatgtcagggccagaagtsgtctcagctaagttagaatgtgataccattgtttacacaagtgtggcctgccttcaagatagggtgaggtgttttatgaccacaggctttatgagttata

SEQ ID NO: 3636 - DNA, 201 bp, Homo sapiens
gtctaaacctaataaatgacaaacacatcaactgagctttctgactcccagtgtagtgttcttttgactctatgaaatatttgtgagcacatgctgtagcyacatcagaccaatcttatttagcttttaggtaacaaagctgaggactgtttctctgttgctatagaccctcaggctgaagatttgtaaggtgagcatggc

SEQ ID NO: 3637 - DNA, 201 bp, Homo sapiens
ccttggtattatactttaaaaactaaagtgcaagtacagatataatacctaatttaagtctcataacaaacctaattgtatatacatttgggatacattgwtttccaatttttatacttgaaaaactttatagagagattaaataacattcctaaggtctaaacctaataaatgacaaacacatcaactgagctttctgac

SEQ ID NO: 3638 - DNA, 201 bp, Homo sapiens
tgcaagttaatttggtagccttcttgtacttgacagacacaaacttgccctaggttctcacctgaaatatataaaaggctgagcaaagaaatatacacccmaaaattctaagaaattctttctcaaccttaagaagcagtcaagaggacaaatcaaataaaaagtccaacgtaactgtaatgactaatactttctgtccta

SEQ ID NO: 3639 - DNA, 201 bp, Homo sapiens
ctacctgttattgaaagtgagactatgaaatcttattatagaacttctttcttttctccatttttaattatttatatgtttgggggccatgtttttgcgtsggtatatgtttttaattgctatctattatgggtggattggccttgactgttgcaaacaataattgacaatatctattatacctgaaattactatatgcac

SEQ ID NO: 3640 - DNA, 201 bp, Homo sapiens
agaaacttctcaagacatatacatggacaagaagcatttaaaaaaaattctcaacgtcacgaatcattcaagaaatgcaaatcaaaatcactatgatactrtccacagcagtcagaaaggctattattgaaaagtcaaaaaataacagatgttagcaaggttgcagaaaaaatgacatgtgtatatactacctacgggaat

SEQ ID NO: 3641 - DNA, 201 bp, Homo sapiens
aattgtcattttgacgtacaaaatttgaagactttctgtcatttgagacagagcagggatccctcttggggtctgccgggtcccccaagcatggaaatgarggaaattcttgagttccttcaagggaaagttgaggcacccagctagtcctgaggagtagatgagcaacttggtaagcaagaaagtaatagtggcttcaaa

SEQ ID NO: 3642 - DNA, 201 bp, Homo sapiens
agtgttctgtgcctgactaggaagttctggtggttttcttagttagcacatgagaggttgacagttgccagtctccagtgaagctgtcaacaggttatacrcaaataagaaattactttaacacatacaaaacttttctttagaagaatgcagacaacttatattcaatttcatttcaaaatgctaccgattttcatattt

SEQ ID NO: 3643 - DNA, 201 bp, Homo sapiens
ctatagaggtggggccatggcagagaatagactcaggggcaagcccactgccctagtgggcttacatggcagaacttccagccaaagatgattctgaggckttacggttttagatttacttgggaccagttatccctttcttctttcctagttctcccttttggaatgagaatgtccgtcctatgcctgtttcaccgttgt

SEQ ID NO: 3644 - DNA, 201 bp, Homo sapiens
atgtttgggcagtgaattctgggttttggggtgtcacaagcatgatctagaaggaggggtacaggcccaaggtgggcacaccccctctgcagaaacggacycagcagagcaggaccagtgtggactctctaaaggccagcccatcctcctcctttcaggctgagggcctccctggccaggcccagacccaatgtctggcct

SEQ ID NO: 3645 - DNA, 201 bp, Homo sapiens
gatctagaaggaggggtacaggcccaaggtgggcacaccccctctgcagaaacggactcagcagagcaggaccagtgtggactctctaaaggccagcccaycctcctcctttcaggctgagggcctccctggccaggcccagacccaatgtctggcctcatttcctgctgtatgatgccagcctttgtaagtcacttgcag

SEQ ID NO: 3646 - DNA, 201 bp, Homo sapiens
tgaggaaggcaataaagcaatgccttcaaaattctgtggaagaataatttggagtgtagaattctaatatccacagcagatattaaataagtatgattacrgagtgaagacatttcaggcatgcaagaactcaaaatgtttacttcttattcagtctttcctcagaagttacttaaggttgcacttatctaaaatgaaata

SEQ ID NO: 3647 - DNA, 201 bp, Homo sapiens
ttgggtgctcagtgggactgtcctgaaaacaggagcaggacagcacaggtctatgtgggttacagatctttgcatcttgcaatgcttcccatctgccaccscagatacatggccctgtcaaagccaaagctcacatagacactgtcagcaaacaattcagtgttcatgaaaaaatctagaacttagtaatagtacatatat

SEQ ID NO: 3648 - DNA, 201 bp, Homo sapiens
aaattcaacaatcctgagatgattggtcatggattcaaggcctaagcaaaactggcttccagcaaattccataggcccttgttttgacctcttctgaaaayggtaggtatcacatttcaccaatcatttttctttacagtaataaccaaaatgaaagcttattttaatttctctaaatagtcaaaggtttctcttgttttc

SEQ ID NO: 3649 - DNA, 201 bp, Homo sapiens
cgtgcctgtagttccagctacttccaaggctgagatggcttaagtctgggagattgaggctgcagtgagccatgattatcaccatactccagctggggtgrcagagtgagaccgtgtttcaaaaacaaacaaacaaaaaacaaaataagtaatctcctctgtgattttttccccagtgtccatgtttttctttaatttctt

SEQ ID NO: 3650 - DNA, 201 bp, Homo sapiens
agaccgtgtttcaaaaacaaacaaacaaaaaacaaaataagtaatctcctctgtgattttttccccagtgtccatgtttttctttaatttctttaacactktagattacaataatttgaaattttttttgatgcttggaacaatttttatcttgaaatgtattttagtattatgatatttatttactttctcccatttttt

SEQ ID NO: 3651 - DNA, 201 bp, Homo sapiens
agttttcacatgcatttggcatgcagactgtgcttgcagactgtggtgggcttgcagactgtggtgctgggcaaaaacagaactagttccactttctatcrgtctattcctgtacaacactatattgtcctatgttattagcatcataatatattgtatttaacagatataactagactcacatcatttttttctttaaaa

SEQ ID NO: 3652 - DNA, 201 bp, Homo sapiens
cagggccacctgaagattgtgtttcccacattctggcagcgttcctcagatgatccaggtgtggcttacacagaccctagtgccgctcaggccatctctcyggaccacacatgaattggtggtaaactttgttggcatccaaatggtgctaactctgcaggtgtgcagagtgtatgagctgtagaggcatggctaccctta

SEQ ID NO: 3653 - DNA, 201 bp, Homo sapiens
agggttcaataattatgtaatcattgctcccataggtatccccattatatttttcaacaattccaataatcaaaatgccagtcctaatattcagtgccacytgccttgctacaattctggtcctcttccatactaatcttccctctatacagatgatagcccttcaagaattgaaaatgctgattatttctgtccctctgt

SEQ ID NO: 3654 - DNA, 201 bp, Homo sapiens
cataactatataagaataagatgctctggacaactaaaatgcctctcatttagcaagccctattctcttgagaaggctgttttggttttaaatagcaaagkttttcttttttcactgtatacccataaatagttaattcttacactagtcagttacctcatgttagagcaattaatatttatgttggccttccccaaacta

SEQ ID NO: 3655 - DNA, 201 bp, Homo sapiens
tattaaaaggaaagaaacagtgaatggtttgctttgagtaacccaccacattgtgcaaatgtttccgaaagtgaaaaggcaccatccgtctgtttaattgsattgtctcagaaatatattcaagtattgagatagctttgaatcacttatacttaagactatcagagaaatttttctctcctctgcttcattagtccaaag

SEQ ID NO: 3656 - DNA, 201 bp, Homo sapiens
taataattttcagggaacagacaaaaagagttcatataaaaatattgagatttatgatgttatcactgctctcaacacaacatcagacaccagaagaaaayagagtggtctttaacattgtaaaaagaaagtatttctaacaactaatttctagactgtcattcaaatttaaagataaaataaggaaaagattaaaatatg

SEQ ID NO: 3657 - DNA, 201 bp, Homo sapiens
gcaagaaggaaggaacttggagtgggaaagaaagatggatagaggggccagtctgggagcataactgaaatgcagacaggtgattaaccaacactgaaaarctctggaagtttctaaaggaagtggggctattctgtctaagaaaactgagggtagaaaataaagggaaatatcctaaatcaaaagattgcttcaggttgg

SEQ ID NO: 3658 - DNA, 201 bp, Homo sapiens
actttaaataaaaatgaaacaaaaaatggaagaaatcaagttgcgttatctaatatgaaaaatgcattcgggttttgtttttttcagaaaaaaagtggttytacatgaagaccagaatctatagcacacaagcaaacattgtctgtgctttcttaatcctctcattcatagatccactcacaagcgcttctgtggccaaaa

SEQ ID NO: 3659 - DNA, 201 bp, Homo sapiens
tcctttctagaaatcacaaattcctcatctttaatttgaaccacttaaaaataggtacacagagtttgaacataccttagaggtattttagggggctctayttaatagataagcccagaaaagttttcagaagtcatgtctttgcctaaccctaaaaaaataagaaggaagagcagtttttaagagaagttttcctataaa

SEQ ID NO: 3660 - DNA, 201 bp, Homo sapiens
aactgggcaatgtgtgtgctccattatgtcaggaacttgaccatgtttacctctggcacagaaaggcccctcactaaacatttgcttaatgaatgactcamcaacctatctattcctctatctatctgtcatctatccatccatctgtccatctgtccatctgtctacctaggaaagcccttgcctcatcttgcattatgc

SEQ ID NO: 3661 - DNA, 201 bp, Homo sapiens
agaggaaacatgtgaaaaggttttataagagtagtgacattagagatagtccttgagaaatgaatacgattttcacatttacgtattaattcattcacttstctagttctttgtttatttagtacataattgttgaaactatatgttgtacccacactatgctagccattgaggataggatggtgagcataatggaacttg
